(12) United States Patent
Hara et al.

(10) Patent No.: US 10,047,385 B2
(45) Date of Patent: Aug. 14, 2018

(54) METHOD FOR MANUFACTURING USEFUL SUBSTANCE

(71) Applicant: AJINOMOTO CO., INC., Tokyo (JP)

(72) Inventors: Yoshihiko Hara, Kanagawa (JP); Keita Fukui, Kanagawa (JP); Akito Chinen, Kanagawa (JP); Suguru Yamakami, Kanagawa (JP)

(73) Assignee: AJINOMOTO CO., INC., Tokyo (JP)

( * ) Notice: Subject to any disclaimer, the term of this patent is extended or adjusted under 35 U.S.C. 154(b) by 365 days.

(21) Appl. No.: 14/990,047

(22) Filed: Jan. 7, 2016

(65) Prior Publication Data

US 2016/0130618 A1    May 12, 2016

Related U.S. Application Data

(63) Continuation of application No. PCT/JP2014/068368, filed on Jul. 9, 2014.

(60) Provisional application No. 61/844,154, filed on Jul. 9, 2013.

(30) Foreign Application Priority Data

Jul. 9, 2013    (JP) .................... 2013-144003

(51) Int. Cl.
| | |
|---|---|
| *C12P 13/14* | (2006.01) |
| *C12P 7/00* | (2006.01) |
| *C12P 13/04* | (2006.01) |
| *C12P 13/00* | (2006.01) |

(52) U.S. Cl.
CPC ............... *C12P 13/14* (2013.01); *C12P 7/00* (2013.01); *C12P 13/001* (2013.01); *C12P 13/04* (2013.01)

(58) Field of Classification Search
None
See application file for complete search history.

(56) References Cited

U.S. PATENT DOCUMENTS

| | | | |
|---|---|---|---|
| 8,222,007 B2 | 7/2012 | Hara et al. | |
| 8,247,201 B2 | 8/2012 | Tajima et al. | |
| 8,404,474 B2 | 3/2013 | Kozlov et al. | |
| 8,628,941 B2 | 1/2014 | Fukui et al. | |
| 8,728,774 B2 | 5/2014 | Rybak et al. | |
| 8,753,849 B2 | 6/2014 | Kozlov et al. | |
| 8,785,161 B2 | 7/2014 | Rybak et al. | |
| 8,969,048 B2 | 3/2015 | Kozlov et al. | |
| 9,080,189 B2 | 7/2015 | Fukui et al. | |
| 2010/0062497 A1 | 3/2010 | Shiraga et al. | |
| 2010/0068774 A1 | 3/2010 | Fukui et al. | |
| 2011/0053233 A1 | 3/2011 | Brown et al. | |
| 2014/0287472 A1 | 9/2014 | Rybak et al. | |
| 2014/0363847 A1 | 12/2014 | Fujii et al. | |
| 2015/0259717 A1 | 9/2015 | Hara et al. | |

FOREIGN PATENT DOCUMENTS

| | | |
|---|---|---|
| JP | 2003-159065 A | 6/2003 |
| WO | WO2008/114721 | 9/2008 |
| WO | WO2008/126896 | 10/2008 |
| WO | WO2011/028643 | 3/2011 |
| WO | WO2013/056318 A1 | 5/2012 |
| WO | WO2013/018734 | 2/2013 |

OTHER PUBLICATIONS

Fukui et al. (Identification of succinate exporter in Corynebacterium glutamicum and its physiological roles under anaerobic conditions, Journal of Biotechnology 154 (2011) 25-34).*
Lodi, T., et al., "Carboxylic acids permeases in yeast: two genes in Kluyveromyces lactis," Gene 2004;339:111-119.
International Search Report for PCT Patent App. No. PCT/JP2014/068368 dated Oct. 14, 2014.
International Report on Patentability for PCT Patent App. No. PCT/JP2014/068368 dated Jan. 12, 2016.
Supplementary Parital European Search Report for European Patent App. No. 14823044.4 dated Jan. 17, 2017.
Database WPI, XP002765209, Jan. 25, 2001, Thomson Scientific, London, GB; AN 2001-159532.
Database Uniprot, May 1, 2013, XP002765210, Database accession No. P0ADD5.
Database GenBank, Jan. 25, 2013, XP002765211, Database accession No. F0203355.

* cited by examiner

*Primary Examiner* — Suzanne Marie Noakes
*Assistant Examiner* — Jae W Lee
(74) *Attorney, Agent, or Firm* — Cermak Nakajima & McGowan LLP; Shelly Guest Cermak

(57) ABSTRACT

A method for producing an objective substance is provided. An objective substance is produced by culturing a microorganism which has been modified so that the activity of a dicarboxylic acid exporter protein is reduced in a medium, and collecting the objective substance from the medium.

12 Claims, 1 Drawing Sheet

METHOD FOR MANUFACTURING USEFUL SUBSTANCE

This application is a Continuation of, and claims priority under 35 U.S.C. § 120 to, International Application No. PCT/JP2014/068368, filed Jul. 9, 2014, and claims priority therethrough under 35 U.S.C. § 119 to Japanese Patent Application No. 2013-144003, filed Jul. 9, 2013, and U.S. Provisional Patent Application No. 61/844,154, filed Jul. 9, 2013, the entireties of which are incorporated by reference herein. Also, the Sequence Listing filed electronically herewith is hereby incorporated by reference (File name: 2016-01-07T_US-500_Seq_List; File size: 1032 KB; Date recorded: Jan. 7, 2016).

BACKGROUND OF THE INVENTION

Field of the Invention

The present invention relates to a method for producing a useful substance using a microorganism.

Brief Description of the Related Art

When producing amino acids such as glutamic acid and alcohols such as isopropyl alcohol by fermentation, succinic acid is produced as one of several by-products (WO2013/018734 and WO2008/114721). Consequently, the yield of the objective substance is decreased and, thus, not only the cost of the raw materials for the fermentation but also the cost of purifying the product are increased, which is uneconomical.

SUMMARY OF THE INVENTION

An aspect of the present invention is to develop a novel technique for improving an objective substance-producing ability of a microorganism and thereby provide a method for efficiently producing an objective substance.

The ability of a microorganism to produce an objective substance can be improved by modifying the microorganism so that the activity of a dicarboxylic acid exporter protein is reduced.

It is an aspect of the present invention to provide a method for producing an objective substance, the method comprising:

culturing a microorganism having an objective substance-producing ability in a medium to produce and accumulate the objective substance in the medium or in cells of the microorganism; and collecting the objective substance from the medium or the cells, wherein the microorganism has been modified so that the activity of a dicarboxylic acid exporter protein is reduced.

It is a further aspect or the present invention to provide the method as described above, wherein the activity of the dicarboxylic acid exporter protein is reduced by attenuating the expression of a gene encoding the dicarboxylic acid exporter protein or by deleting the gene.

It is a further aspect or the present invention to provide the method as described above, wherein the gene encoding the dicarboxylic acid exporter protein is selected from the group consisting of yjjP, yjjB, yeeA, ynfM, sucE1, and combinations thereof.

It is a further aspect or the present invention to provide the method as described above, wherein the yjjP gene is a DNA selected from the group consisting of:

(A) a DNA encoding a protein comprising the amino acid sequence of SEQ ID NO: 158 or 160;

(B) a DNA encoding a protein comprising the amino acid sequence of SEQ ID NO: 158 or 160, but including substitution, deletion, insertion, or addition of one or several amino acid residues, the protein having an activity to export a dicarboxylic acid;

(C) a DNA comprising the nucleotide sequence of SEQ ID NO: 157 or 159; and (D) a DNA able to hybridize under stringent conditions with a nucleotide sequence complementary to the nucleotide sequence of SEQ ID NO: 157 or 159, or with a probe that can be prepared from the complementary nucleotide sequence, and encoding a protein having an activity to export a dicarboxylic acid.

It is a further aspect or the present invention to provide the method as described above, wherein the yjjB gene is a DNA selected from the group consisting of:

(A) DNA encoding a protein comprising the amino acid sequence of SEQ ID NO: 162 or 164;

(B) DNA encoding a protein comprising the amino acid sequence of SEQ ID NO: 162 or 164, but including substitution, deletion, insertion, or addition of one or several amino acid residues, the protein having an activity to export a dicarboxylic acid;

(C) DNA comprising the nucleotide sequence of SEQ ID NO: 161 or 163; and (D) DNA able to hybridize under stringent conditions with a nucleotide sequence complementary to the nucleotide sequence of SEQ ID NO: 161 or 163, or with a probe that can be prepared from the complementary nucleotide sequence, and encoding a protein having an activity to export a dicarboxylic acid.

It is a further aspect or the present invention to provide the method as described above, wherein the yeeA gene is a DNA selected from the group consisting of:

(A) DNA encoding a protein comprising the amino acid sequence of SEQ ID NO: 166, 168, or 170;

(B) DNA encoding a protein comprising the amino acid sequence of SEQ ID NO: 166, 168, or 170, but including substitution, deletion, insertion, or addition of one or several amino acid residues, the protein having an activity to export a dicarboxylic acid;

(C) DNA comprising the nucleotide sequence of SEQ ID NO: 165, 167, or 169; and (D) DNA able to hybridize under stringent conditions with a nucleotide sequence complementary to the nucleotide sequence of SEQ ID NO: 165, 167, or 169, or with a probe that can be prepared from the complementary nucleotide sequence, and encoding a protein having an activity to export a dicarboxylic acid.

It is a further aspect or the present invention to provide the method as described above, wherein the ynfM gene is a DNA selected from the group consisting of:

(A) DNA encoding a protein comprising the amino acid sequence of SEQ ID NO: 172, 174, 176, 178, or 180;

(B) DNA encoding a protein comprising the amino acid sequence of SEQ ID NO: 172, 174, 176, 178, or 180, but including substitution, deletion, insertion, or addition of one or several amino acid residues, the protein having an activity to export a dicarboxylic acid;

(C) DNA comprising the nucleotide sequence of SEQ ID NO: 171, 173, 175, 177, or 179; and (D) DNA able to hybridize under stringent conditions with a nucleotide sequence complementary to the nucleotide sequence of SEQ ID NO: 171, 173, 175, 177, or 179 or with a probe that can be prepared from the complementary nucleotide sequence, and encoding a protein having an activity to export a dicarboxylic acid.

It is a further aspect or the present invention to provide the method as described above, wherein the sucE1 gene is a DNA selected from the group consisting of:

(A) DNA encoding a protein comprising the amino acid sequence of SEQ ID NO: 278 or 280;

(B) DNA encoding a protein comprising the amino acid sequence of SEQ ID NO: 278 or 280, but including substitution, deletion, insertion, or addition of one or several amino acid residues, the protein having an activity to export a dicarboxylic acid;

(C) DNA comprising the nucleotide sequence of SEQ ID NO: 277 or 279; and (D) DNA able to hybridize under stringent conditions with a nucleotide sequence complementary to the nucleotide sequence of SEQ ID NO: 277 or 279, or with a probe that can be prepared from the complementary nucleotide sequence, and encoding a protein having an activity to export a dicarboxylic acid.

It is a further aspect or the present invention to provide the method as described above, wherein the objective substance is a metabolite derived from acetyl-CoA and/or an L-amino acid.

It is a further aspect or the present invention to provide the method as described above, wherein the metabolite derived from acetyl-CoA and/or the L-amino acid is selected from the group consisting of isopropyl alcohol, ethanol, acetone, propylene, isoprene, 1,3-butanediol, 1,4-butanediol, 1-propanol, 1,3-propanediol, 1,2-propanediol, ethylene glycol, isobutanol, and combinations thereof.

It is a further aspect or the present invention to provide the method as described above, wherein the metabolite derived from acetyl-CoA and/or the L-amino acid is selected from the group consisting of citric acid, itaconic acid, acetic acid, butyric acid, 3-hydroxybutyric acid, polyhydroxybutyric acid, 3-hydroxyisobutyric acid, 3-aminoisobutyric acid, 2-hydroxyisobutyric acid, methacrylic acid, 6-aminocaproic acid, and combinations thereof.

It is a further aspect or the present invention to provide the method as described above, wherein the metabolite derived from acetyl-CoA and/or the L-amino acid is substances selected from the group consisting of polyglutamic acid, L-glutamic acid, L-glutamine, L-arginine, L-ornithine, L-citrulline, L-leucine, L-isoleucine, L-valine, L-cysteine, L-serine, L-proline, and combinations thereof.

It is a further aspect or the present invention to provide the method as described above, wherein the L-glutamic acid is monoammonium L-glutamate or monosodium L-glutamate.

It is a further aspect or the present invention to provide the method as described above, wherein the microorganism is a coryneform bacterium or a bacterium belonging to the family Enterobacteriaceae.

It is a further aspect or the present invention to provide the method as described above, wherein the coryneform bacterium is *Corynebacterium glutamicum*.

It is a further aspect or the present invention to provide the method as described above, wherein the bacterium belonging to the family Enterobacteriaceae is *Escherichia coli*, *Pantoea ananatis*, or *Enterobacter aerogenes*.

It is a further aspect or the present invention to provide the method as described above, wherein the dicarboxylic acid is selected from the group consisting of malic acid, succinic acid, fumaric acid, 2-hydroxyglutaric acid, and α-ketoglutaric acid.

It is a further aspect or the present invention to provide the method as described above, wherein the microorganism has been further modified so that malyl-CoA-producing ability is increased.

It is a further aspect or the present invention to provide the method as described above, wherein the microorganism has been further modified so that α-ketoglutarate synthase activity is increased.

DESCRIPTION OF THE PREFERRED EMBODIMENTS

Figure 1:
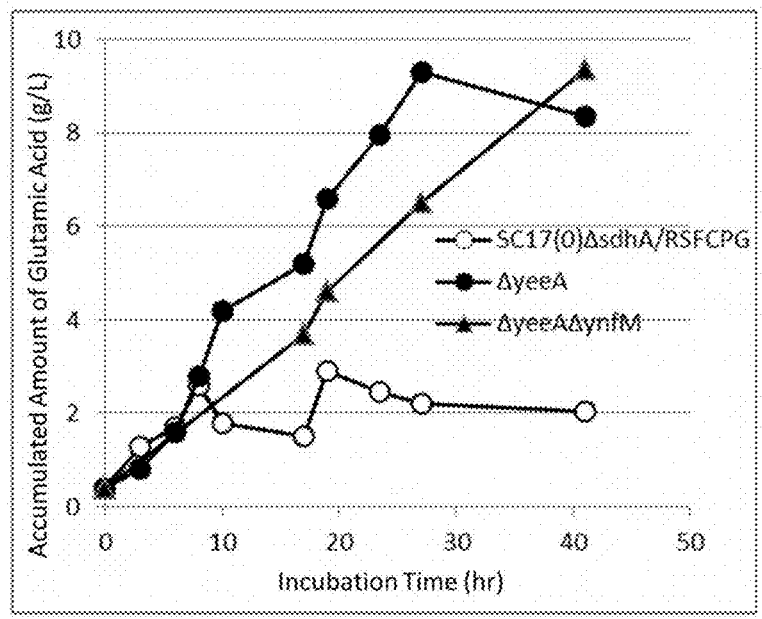
FIG. 1 indicates the effect of reduced activities of dicarboxylic acid exporter proteins on the production of L-glutamic acid.

Hereafter, the present invention will be explained in detail.

<1> Microorganism of the Present Invention

The microorganism can be a microorganism having an objective substance-producing ability, which has been modified so that the activity of a dicarboxylic acid exporter protein is reduced.

<1-1> Microorganism Having Objective Substance-Producing Ability

The term "objective substance" can be a compound such as acetyl-CoA, metabolites derived from acetyl-CoA (specifically, useful fermentation metabolites derived from acetyl-CoA), and L-amino acids. Specific examples of metabolites derived from acetyl-CoA and L-amino acids include, for example, organic compounds such as isopropyl alcohol, ethanol, acetone, propylene, isoprene, 1,3-butanediol, 1-propanol, 1,3-propanediol, 1,2-propanediol, ethylene glycol, and isobutanol; organic acids such as citric acid, itaconic acid, acetic acid, butyric acid, 3-hydroxybutyric acid, polyhydroxybutyric acid, 3-hydroxyisobutyric acid, 3-aminoisobutyric acid, 2-hydroxyisobutyric acid, methacrylic acid, and 6-aminocaproic acid; and L-amino acids such as polyglutamic acid, L-glutamic acid, L-glutamine, L-arginine, L-ornithine, L-citrulline, L-leucine, L-isoleucine, L-valine, L-cysteine, L-serine, and L-proline. Any amino acid can mean an L-amino acid unless otherwise noted. One kind of objective substance may be produced, or two or more kinds of objective substances may be produced.

The phrase "objective substance-producing ability" can mean an ability to produce and accumulate an objective substance in cells or in a medium when the microorganism is cultured in the medium, to such a degree that the objective substance can be collected from the cells or the medium. The microorganism having an objective substance-producing ability may be a microorganism that is able to accumulate the objective substance in a medium in an amount larger than that obtainable with a non-modified strain. Moreover, the microorganism having an objective substance-producing ability may also be a microorganism that is able to accumulate the objective substance in an amount of 0.5 g/L or more, or in an amount of 1.0 g/L or more, in a medium. The objective substance produced by the microorganism may be one kind of substance or two or more kinds of substances.

Examples of the microorganism include bacteria and yeast. Among them, bacteria are a particular example.

Examples of the bacteria include bacteria belonging to the family Enterobacteriaceae and coryneform bacteria. Examples of the bacteria also include *Alicyclobacillus* bacteria and *Bacillus* bacteria.

Examples of bacteria belonging to the family Enterobacteriaceae include bacteria belonging to the genus *Escherichia*, *Enterobacter*, *Pantoea*, *Klebsiella*, *Serratia*, *Erwinia*, *Photorhabdus*, *Providencia*, *Salmonella*, *Morganella*, or the like. Specifically, bacteria classified into the family Enterobacteriaceae according to the taxonomy used in the NCBI (National Center for Biotechnology Information) database (http://www.ncbi.nlm.nih.gov/Taxonomy/Browser/wwwtax.cgi?id=91347) can be used.

The *Escherichia* bacteria are not particularly limited, and examples thereof include those classified into the genus *Escherichia* according to the taxonomy known to those skilled in the field of microbiology. Examples of the *Escherichia* bacteria include, for example, those described in the work of Neidhardt et al. (Backmann B. J., 1996, Derivations and Genotypes of some mutant derivatives of *Escherichia coli* K-12, pp. 2460-2488, Table 1, In F. D. Neidhardt (ed.), *Escherichia coli* and *Salmonella* Cellular and Molecular Biology/Second Edition, American Society for Microbiology Press, Washington, D.C.). Examples of the *Escherichia* bacteria include, for example, *Escherichia coli*. Specific examples of *Escherichia coli* include, for example, *Escherichia coli* W3110 strain (ATCC 27325) and *Escherichia coli* MG1655 strain (ATCC 47076), which are derived from the prototype wild-type strain K-12.

The *Enterobacter* bacteria are not particularly limited, and examples include those classified into the genus *Enterobacter* according to the taxonomy known to those skilled in the field of microbiology. Examples the *Enterobacter* bacterium include, for example, *Enterobacter agglomerans* and *Enterobacter aerogenes*. Specific examples of *Enterobacter agglomerans* include, for example, the *Enterobacter agglomerans* ATCC 12287 strain. Specific examples of *Enterobacter aerogenes* include, for example, the *Enterobacter aerogenes* ATCC 13048 strain, NBRC 12010 strain (Biotechnol. Bioeng., 2007, Mar. 27; 98(2):340-348), and AJ110637 strain (FERM BP-10955). Examples the *Enterobacter* bacteria also include, for example, the strains described in European Patent Application Laid-open (EP-A) No. 0952221. In addition, *Enterobacter agglomerans* also include some strains classified as *Pantoea agglomerans*.

The *Pantoea* bacteria are not particularly limited, and examples include those classified into the genus *Pantoea* according to the taxonomy known to those skilled in the field of microbiology. Examples the *Pantoea* bacteria include, for example, *Pantoea ananatis*, *Pantoea stewartii*, *Pantoea agglomerans*, and *Pantoea citrea*. Specific examples of *Pantoea ananatis* include, for example, the *Pantoea ananatis* LMG20103 strain, AJ13355 strain (FERM BP-6614), AJ13356 strain (FERM BP-6615), AJ13601 strain (FERM BP-7207), SC17 strain (FERM BP-11091), and SC17(0) strain (VKPM B-9246). Some strains of *Enterobacter agglomerans* were recently reclassified into *Pantoea agglomerans*, *Pantoea ananatis*, *Pantoea stewartii*, or the like on the basis of nucleotide sequence analysis of 16S rRNA etc. (Int. J. Syst. Bacteriol., 43, 162-173 (1993)). In the present invention, the *Pantoea* bacteria include those reclassified into the genus *Pantoea* as described above.

Examples of the *Erwinia* bacteria include *Erwinia amylovora* and *Erwinia carotovora*. Examples of the *Klebsiella* bacteria include *Klebsiella planticola*.

Examples of the coryneform bacteria include bacteria belonging to the genus *Corynebacterium*, *Brevibacterium*, *Microbacterium*, or the like.

Specific examples of the coryneform bacteria include the following species.

*Corynebacterium acetoacidophilum*
*Corynebacterium acetoglutamicum*
*Corynebacterium alkanolyticum*
*Corynebacterium callunae*
*Corynebacterium glutamicum*
*Corynebacterium lilium*
*Corynebacterium melassecola*
*Corynebacterium thermoaminogenes* (*Corynebacterium efficiens*)
*Corynebacterium herculis*
*Brevibacterium divaricatum*
*Brevibacterium flavum*
*Brevibacterium immariophilum*
*Brevibacterium lactofermentum* (*Corynebacterium glutamicum*)
*Brevibacterium roseum*
*Brevibacterium saccharolyticum*
*Brevibacterium thiogenitalis*
*Corynebacterium ammoniagenes* (*Corynebacterium stationis*)
*Brevibacterium album*
*Brevibacterium cerinum*
*Microbacterium ammoniaphilum*

Specific examples of the coryneform bacteria include the following strains.

*Corynebacterium acetoacidophilum* ATCC 13870
*Corynebacterium acetoglutamicum* ATCC 15806
*Corynebacterium alkanolyticum* ATCC 21511
*Corynebacterium callunae* ATCC 15991
*Corynebacterium glutamicum* ATCC 13020, ATCC 13032, ATCC 13060, ATCC 13869, FERM BP-734
*Corynebacterium lilium* ATCC 15990
*Corynebacterium melassecola* ATCC 17965
*Corynebacterium thermoaminogenes* AJ12340 (FERM BP-1539)
*Corynebacterium herculis* ATCC 13868
*Brevibacterium divaricatum* ATCC 14020
*Brevibacterium flavum* ATCC 13826, ATCC 14067, AJ12418 (FERM BP-2205)
*Brevibacterium immariophilum* ATCC 14068
*Brevibacterium lactofermentum* ATCC 13869
*Brevibacterium roseum* ATCC 13825
*Brevibacterium saccharolyticum* ATCC 14066
*Brevibacterium thiogenitalis* ATCC 19240
*Corynebacterium ammoniagenes* (*Corynebacterium stationis*) ATCC 6871, ATCC 6872
*Brevibacterium album* ATCC 15111
*Brevibacterium cerinum* ATCC 15112
*Microbacterium ammoniaphilum* ATCC 15354

The *Corynebacterium* bacteria include bacteria that had previously been classified into the genus *Brevibacterium*, but are presently united into the genus *Corynebacterium* (Int. J. Syst. Bacteriol., 41, 255 (1991)). Moreover, *Corynebacterium stationis* includes bacteria that had previously been classified as *Corynebacterium ammoniagenes*, but are presently re-classified into *Corynebacterium* stationis on the basis of nucleotide sequence analysis of 16S rRNA etc. (Int. J. Syst. Evol. Microbiol., 60, 874-879 (2010)).

The *Bacillus* bacteria are not particularly limited, and examples include those classified into the genus *Bacillus* according to the taxonomy known to those skilled in the field of microbiology. Examples the *Bacillus* bacteria include, for example, the following species.

*Bacillus subtilis*
*Bacillus amyloliquefaciens*
*Bacillus pumilus*
*Bacillus licheniformis*
*Bacillus megaterium*

*Bacillus brevis*
*Bacillus polymixa*
*Bacillus stearothermophilus*

Specific examples of *Bacillus subtilis* include, for example, *Bacillus subtilis* 168 Marburg strain (ATCC 6051) and *Bacillus subtilis* PY79 (Plasmid, 1984, 12, 1-9). Specific examples of *Bacillus amyloliquefaciens* include, for example, *Bacillus amyloliquefaciens* T strain (ATCC 23842) and *Bacillus amyloliquefaciens* N strain (ATCC 23845).

These strains are available from, for example, the American Type Culture Collection (Address: 12301 Parklawn Drive, Rockville, Md. 20852, P.O. Box 1549, Manassas, Va. 20108, United States of America). That is, registration numbers are given to the respective strains, and the strains can be ordered by using these registration numbers (refer to http://www.atcc.org/). The registration numbers of the strains are listed in the catalogue of the American Type Culture Collection.

The microorganism may be a bacterium inherently having an objective substance-producing ability, or may be a microorganism modified so that it has an objective substance-producing ability. The microorganism having an objective substance-producing ability can be obtained by imparting an objective substance-producing ability to such a microorganism as mentioned above, or by enhancing an objective substance-producing ability of such a microorganism as mentioned above.

To impart or enhance an objective substance-producing ability, methods conventionally employed in the breeding of amino acid-producing strains of coryneform bacteria, *Escherichia* bacteria, and so forth (see "Amino Acid Fermentation", Gakkai Shuppan Center (Ltd.), 1st Edition, published May 30, 1986, pp. 77-100) can be used. Examples of such methods include, for example, acquiring an auxotrophic mutant strain, acquiring an objective substance analogue-resistant strain, acquiring a metabolic regulation mutant strain, and constructing a recombinant strain in which the activity of an objective substance biosynthetic enzyme is enhanced. In the breeding of objective substance-producing microorganisms, one of the above-described properties such as auxotrophy, analogue resistance, and metabolic regulation mutation may be imparted alone, or two or three or more of such properties may be imparted in combination. Also, in the breeding of objective substance-producing microorganisms, the activity of one of objective substance biosynthetic enzymes may be enhanced alone, or the activities of two or three or more of such enzymes may be enhanced in combination. Furthermore, imparting property(s) such as auxotrophy, analogue resistance, and metabolic regulation mutation can be combined with enhancing the activity(s) of biosynthetic enzyme(s).

An auxotrophic mutant strain, objective substance analogue-resistant strain, or metabolic regulation mutant strain having an objective substance-producing ability can be obtained by subjecting a parent strain or wild-type strain to a usual mutagenesis treatment, and then selecting a strain exhibiting autotrophy, analogue resistance, or a metabolic regulation mutation, and having an objective substance-producing ability from the obtained mutant strains. Examples of the usual mutagenesis treatment include irradiation of X-ray or ultraviolet and a treatment with a mutation agent such as N-methyl-N'-nitro-N-nitrosoguanidine (MNNG), ethyl methanesulfonate (EMS), and methyl methanesulfonate (MMS).

An objective substance-producing ability can also be imparted or enhanced by enhancing the activity of an enzyme involved in biosynthesis of an objective substance. An enzyme activity can be enhanced by, for example, modifying a microorganism so that the expression of a gene coding for the enzyme is enhanced. Methods for enhancing gene expression are described in WO00/18935, EP 1010755 A, and so forth. The detailed procedures for enhancing enzyme activity will be described later.

Furthermore, an objective substance-producing ability can also be imparted or enhanced by reducing the activity of an enzyme that catalyzes a reaction branching away from the biosynthetic pathway of the objective substance to generate a compound other than the objective substance. Such enzymes can include an enzyme involved in decomposition of the objective substance. The method for reducing enzyme activity will be described later.

Hereafter, objective substance-producing microorganisms and methods for imparting or enhancing an objective substance-producing ability will be specifically exemplified. All of the properties of the objective substance-producing microorganisms and modifications for imparting or enhancing an objective substance-producing ability may be used independently or in any appropriate combination.

<L-Glutamic Acid-Producing Microorganisms>

Examples of methods for imparting or enhancing L-glutamic acid-producing ability include, for example, a method of modifying a microorganism so that the microorganism has an increased activity or activities of one or more kinds of enzymes such as the L-glutamic acid biosynthesis enzymes. Examples of such enzymes include, but are not particularly limited to, glutamate dehydrogenase (gdhA), glutamine synthetase (glnA), glutamate synthetase (gltBD), isocitrate dehydrogenase (icdA), aconitate hydratase (acnA, acnB), citrate synthase (gltA), methylcitrate synthase (prpC), phosphoenolpyruvate carboxylase (ppc), pyruvate carboxylase (pyc), pyruvate kinase (pykA, pykF), pyruvate dehydrogenase (aceEF, lpdA), phosphoenolpyruvate synthase (ppsA), enolase (eno), phosphoglyceromutase (pgmA, pgmI), phosphoglycerate kinase (pgk), glyceraldehyde-3-phophate dehydrogenase (gapA), triose phosphate isomerase (tpiA), fructose bisphosphate aldolase (fbp), phosphofructokinase (pfkA, pfkB), glucose phosphate isomerase (pgi), 6-phosphogluconate dehydratase (edd), 2-keto-3-deoxy-6-phosphogluconate aldolase (eda), transhydrogenase, and so forth. Shown in the parentheses after the names of the enzymes are the names of the genes thereof (the same shall apply hereafter). Particular examples can include, for example, glutamate dehydrogenase, citrate synthase, phosphoenol pyruvate carboxylase, and methylcitrate synthase, among these enzymes.

Examples of strains belonging to the family Enterobacteriaceae and modified so that the expression of the citrate synthase gene, phosphoenolpyruvate carboxylase gene, and/or glutamate dehydrogenase gene are increased include those disclosed in EP 1078989 A, EP 955368 A, and EP 952221 A. Furthermore, examples of strains belonging to the family Enterobacteriaceae and modified so that the expression of a gene of the Entner-Doudoroff pathway (edd, eda) is increased include those disclosed in EP 1352966 B. Also, examples of coryneform bacteria modified so that expression of the glutamate synthetase gene (gltBD) is increased include those disclosed in WO99/07853.

Examples of methods for imparting or enhancing L-glutamic acid-producing ability also include, for example, a method of modifying a microorganism so that the microorganism has a reduced activity or activities of one or more kinds of enzymes that catalyze a reaction branching away from the biosynthesis pathway of L-glutamine to generate a compound other than L-glutamic acid. Examples of such enzymes include, but are not particularly limited to, α-ketoglutarate dehydrogenase (sucA, odhA), succinate dehydrogenase (sdhABCD), phosphotransacetylase (pta), acetate kinase (ack), acetohydroxy acid synthase (ilvG), acetolactate synthase (ilvI etc), formate acetyltransferase (pfl), lactate dehydrogenase (ldh), alcohol dehydrogenase (adh), glutamate decarboxylase (gadAB), 1-pyroline-5-carboxylate dehydrogenase (putA), and so forth. delete particular example is, for example, the α-ketoglutarate dehydrogenase activity.

Methods for deleting or reducing the α-ketoglutarate dehydrogenase activity of *Escherichia* bacteria are disclosed in Japanese Patent Laid-open (Kokai) Nos. h5-244970 and h7-203980 etc. Furthermore, methods for deleting or reducing the α-ketoglutarate dehydrogenase activity of Coryneform bacteria are disclosed in WO95/34672. Methods for deleting or reducing the α-ketoglutarate dehydrogenase activity of Enterobacteriaceae bacteria such as *Pantoea* bacteria, *Enterobacter* bacteria, *Klebsiella* bacteria, and *Erwinia* bacteria are disclosed in U.S. Pat. Nos. 6,197,559, 6,682,912, 6,331,419, 8,129,151, and WO2008/075483. Methods for deleting or reducing the α-ketoglutarate dehydrogenase activity of Coryneform bacteria and *Pantoea* bacteria are disclosed in WO2008/075483.

For example, in order to reduce the α-ketoglutarate dehydrogenase activity, sucA (odhA) gene encoding the E1o subunit of the enzyme can be modified. Examples of strains in which the α-ketoglutarate dehydrogenase activity is reduced include, for example, the following strains.

*Brevibacterium lactofermentum* ΔS strain (WO95/34672)
*Brevibacterium lactofermentum* AJ12821 (FERM BP-4172, French Patent No. 9401748)
*Brevibacterium flavum* AJ12822 (FERM BP-4173, French Patent No. 9401748)
*Corynebacterium glutamicum* AJ12823 (FERM BP-4174, French Patent No. 9401748)
*Corynebacterium glutamicum* ATCC13869, OAGN, OA2-2, and OAGN2-2 (WO2006/028298)
*E. coli* W3110sucA::Km$^r$
*E. coli* AJ12624 (FERM BP-3853)
*E. coli* AJ12628 (FERM BP-3854)
*E. coli* AJ12949 (FERM BP-4881)
*Brevibacterium lactofermentum* ΔS strain (WO95/34672)
*Pantoea ananatis* AJ13601 (FERM BP-7207, EP1078989)
*Pantoea ananatis* AJ13356 (FERM BP-6615, U.S. Pat. No. 6,331,419)
*Pantoea ananatis* SC17sucA (FERM BP-8646, WO2005/085419)
*Klebsiella planticola* AJ13410 (FERM BP-6617, U.S. Pat. No. 6,197,559)

Examples of L-glutamic acid-producing bacteria and parent strains which can be used to derive them also include the *Pantoea ananatis* AJ13355 strain (FERM BP-6614), *Pantoea ananatis* SC17 strain (FERM BP-11091), and *Pantoea ananatis* SC17(0) strain (VKPM B-9246). The AJ13355 strain is a strain isolated from soil in Iwata-shi, Shizuoka-ken, Japan as a strain that can proliferate in a low pH medium containing L-glutamic acid and a carbon source. The SC17 strain is a strain selected as a low phlegm-producing mutant strain from the AJ13355 strain (U.S. Pat. No. 6,596,517). The SC17 strain was deposited at the independent administrative agency, National Institute of Advanced Industrial Science and Technology, International Patent Organism Depositary (currently independent administrative agency, National Institute of Technology and Evaluation, International Patent Organism Depositary, #120, 2-5-8 Kazusakamatari, Kisarazu-shi, Chiba-ken, 292-0818, Japan) on Feb. 4, 2009, and assigned an accession number of FERM BP-11091. The AJ13355 strain was deposited at the National Institute of Bioscience and Human Technology, Agency of Industrial Science and Technology (currently, independent administrative agency, National Institute of Technology and Evaluation, International Patent Organism Depositary, #120, 2-5-8 Kazusakamatari, Kisarazu-shi, Chiba-ken, 292-0818, Japan) on Feb. 19, 1998 and assigned an accession number of FERM P-16644. Then, the deposit was converted to an international deposit under the provisions of Budapest Treaty on Jan. 11, 1999, and assigned an accession number of FERM BP-6614.

Furthermore, examples of L-glutamic acid-producing bacteria and parent strains which can be used to derive them also include *Pantoea* bacteria deficient in the α-ketoglutarate dehydrogenase activity or having a reduced α-ketoglutarate dehydrogenase activity. Examples of such strains include the AJ13356 strain (U.S. Pat. No. 6,331,419), which is an α-KGDH-E1 subunit (sucA) gene-deficient strain of the AJ13355 strain, and the SC17sucA strain (U.S. Pat. No. 6,596,517), which is a sucA gene-deficient strain of the SC17 strain. The AJ13356 strain was deposited at the National Institute of Bioscience and Human-Technology, Agency of Industrial Science and Technology (currently, independent administrative agency, National Institute of Technology and Evaluation, International Patent Organism Depositary, #120, 2-5-8 Kazusakamatari, Kisarazu-shi, Chiba-ken, 292-0818, Japan) on Feb. 19, 1998, and assigned an accession number of FERM P-16645. Then, the deposit was converted into an international deposit under the provisions of the Budapest Treaty on Jan. 11, 1999, and assigned an accession number of FERM BP-6616. The SC17sucA strain was assigned a private number of AJ417, and deposited at the National Institute of Advanced Industrial Science and Technology, International Patent Organism Depositary (currently, independent administrative agency, National Institute of Technology and Evaluation, International Patent Organism Depositary, #120, 2-5-8 Kazusakamatari, Kisarazu-shi, Chiba-ken, 292-0818, Japan) on Feb. 26, 2004, under an accession number of FERM BP-08646.

The AJ13355 strain was identified as *Enterobacter agglomerans* when it was isolated, but it was recently reclassified as *Pantoea ananatis* on the basis of nucleotide sequencing of 16S rRNA and so forth. Therefore, although the AJ13355, AJ13356, and AJ13601 strains are deposited at the aforementioned depository as *Enterobacter agglomerans*, they are referred to as *Pantoea ananatis* in this specification.

Furthermore, examples of L-glutamic acid-producing bacteria and parent strains which can be used to derive them also include *Pantoea* bacteria such as the SC17sucA/RS-FCPG+pSTVCB strain, AJ13601 strain, NP106 strain, and NA1 strain. The SC17sucA/RSFCPG+pSTVCB strain was obtained by introducing the plasmid RSFCPG containing the citrate synthase gene (gltA), phosphoenolpyruvate carboxylase gene (ppsA), and glutamate dehydrogenase gene (gdhA) derived from *Escherichia coli*, and the plasmid pSTVCB containing the citrate synthase gene (gltA) derived from *Brevibacterium lactofermentum*, into the SC17sucA strain. The AJ13601 strain includes the SC17sucA/RSFCPG+pSTVCB strain and was selected for it's resistance to a high concentration of L-glutamic acid at a low pH. The NP106 strain was obtained from the AJ13601 strain by curing the RSFCPG and pSTVCB plasmids. The AJ13601 strain was deposited at the National Institute of Bioscience and Human Technology, Agency of Industrial Science and Technology (currently, independent administrative agency, National Institute of Technology and Evaluation, International Patent Organism Depositary, #120, 2-5-8 Kazusakamatari, Kisarazu-shi, Chiba-ken, 292-0818, Japan) on Aug. 18, 1999, and assigned an accession number FERM P-17516. Then, the deposit was converted to an international deposit under the provisions of the Budapest Treaty on Jul. 6, 2000, and assigned an accession number FERM BP-7207.

Examples of L-glutamic acid-producing bacteria and parent strains which can be used to derive them also include strains in which both the α-ketoglutarate dehydrogenase (sucA) activity and the succinate dehydrogenase (sdh) activity are reduced or deleted (Japanese Patent Laid-open (Kokai) No. 2010-041920). Specific examples of such strains include, for example, the sucAsdhA double-deficient strain of *Pantoea ananatis* NA1 strain and *Corynebacterium glutamicum* 8L3GΔSDH strain, which is the odhAsdhA double-deficient strain of *Corynebacterium glutamicum* ATCC 14067 (Japanese Patent Laid-open (Kokai) No. 2010-041920).

Examples of L-glutamic acid-producing bacteria and parent strains which can be used to derive them also include auxotrophic mutant strains. Specific examples of auxotrophic mutant strains include, for example, *E. coli* VL334thrC$^+$ (VKPM B-8961, EP 1172433). *E. coli* VL334 (VKPM B-1641) is an L-isoleucine and L-threonine auxotrophic strain having mutations in the thrC and ilvA genes (U.S. Pat. No. 4,278,765). *E. coli* VL334thrC$^+$ is an L-isoleucine-auxotrophic L-glutamic acid-producing bacterium obtained by introducing a wild-type allele of the thrC gene into the VL334 strain. The wild-type allele of the thrC gene was introduced by the method of general transduction using a bacteriophage P1 grown on the wild-type *E. coli* K-12 strain (VKPM B-7) cells.

Examples of L-glutamic acid-producing bacteria and parent strains which can be used to derive them also include strains having resistance to an aspartic acid analogue. Such strains can also be deficient in the α-ketoglutarate dehydrogenase activity. Specific examples of strains having resistance to an aspartic acid analogue and deficient in the α-ketoglutarate dehydrogenase activity include, for example, *E. coli* AJ13199 (FERM BP-5807, U.S. Pat. No. 5,908,768), *E. coli* FFRM P-12379, which additionally has a lowered L-glutamic acid-decomposing ability (U.S. Pat. No. 5,393,671), and *E. coli* AJ13138 (FERM BP-5565, U.S. Pat. No. 6,110,714).

Examples of methods for imparting or enhancing L-glutamic acid-producing ability also include a method of modifying a bacterium so that the D-xylulose-5-phosphate phosphoketolase activity and/or the fructose-6-phosphate phosphoketolase activity are/is enhanced (Japanese Patent Laid-open (Kohyo) No. 2008-509661). Either the D-xylulose-5-phosphate phosphoketolase activity or the fructose-6-phosphate phosphoketolase activity may be enhanced, or both may be enhanced. In this specification, D-xylulose-5-phosphate phosphoketolase and fructose-6-phosphate phosphoketolase may be collectively referred to as phosphoketolase.

The D-xylulose-5-phosphate phosphoketolase activity can mean an activity for converting xylulose-5-phosphate into glycelaldehyde-3-phosphate and acetyl phosphate by consuming phosphoric acid to release one molecule of $H_2O$. This activity can be measured by the method described by Goldberg, M. et al. (Methods Enzymol., 9, 515-520, 1996) or the method described by L. Meile (J. Bacteriol., 183: 2929-2936, 2001).

The fructose-6-phosphate phosphoketolase activity can mean an activity for converting fructose-6-phosphate into erythrose-4-phosphate and acetyl phosphate by consuming phosphoric acid to release one molecule of $H_2O$. This activity can be measured by the method described by Racker, E. (Methods Enzymol., 5, 276-280, 1962) or the method described by L. Meile (J. Bacteriol., 183:2929-2936, 2001).

Examples of methods for imparting or enhancing L-glutamine-producing ability can also include, for example, a method of amplifying the yhfK gene (WO2005/085419) or the ybjL gene (WO2008/133161), which is an L-glutamic acid secretion gene.

Furthermore, examples of methods for imparting or enhancing L-glutamic acid-producing ability to or in coryneform bacteria also include by imparting resistance to an organic acid analogue, respiratory inhibitor, or the like, and by imparting sensitivity to a cell wall synthesis inhibitor. Specific examples imparting monofluoroacetic acid resistance (Japanese Patent Laid-open (Kokai) No. 50-113209), imparting adenine resistance or thymine resistance (Japanese Patent Laid-open (Kokai) No. 57-065198), attenuating the urease activity (Japanese Patent Laid-open (Kokai) No. 52-038088), imparting malonic acid resistance (Japanese Patent Laid-open (Kokai) No. 52-038088), imparting resistance to benzopyrones or naphthoquinones (Japanese Patent Laid-open (Kokai) No. 56-1889), imparting HOQNO resistance (Japanese Patent Laid-open (Kokai) No. 56-140895), imparting α-ketomalonic acid resistance (Japanese Patent Laid-open (Kokai) No. 57-2689), imparting guanidine resistance (Japanese Patent Laid-open (Kokai) No. 56-35981), imparting sensitivity to penicillin (Japanese Patent Laid-open (Kokai) No. 4-88994), and so forth.

Specific examples of such resistant bacteria include the following strains.

*Brevibacterium flavum* AJ3949 (FERM BP-2632, refer to Japanese Patent Laid-open (Kokai) No. 50-113209)

*Corynebacterium glutamicum* AJ11628 (FERM P-5736, refer to Japanese Patent Laid-open (Kokai) No. 57-065198)

*Brevibacterium flavum* AJ11355 (FERM P-5007, refer to Japanese Patent Laid-open (Kokai) No. 56-1889)

*Corynebacterium glutamicum* AJ11368 (FERM P-5020, refer to Japanese Patent Laid-open (Kokai) No. 56-1889)

*Brevibacterium flavum* AJ11217 (FERM P-4318, refer to Japanese Patent Laid-open (Kokai) No. 57-2869)

*Corynebacterium glutamicum* AJ11218 (FERM P-4319, refer to Japanese Patent Laid-open (Kokai) No. 57-2869)

*Brevibacterium flavum* AJ11564 (FERM BP-5472, refer to Japanese Patent Laid-open (Kokai) No. 56-140895)

*Brevibacterium flavum* AJ11439 (FERM BP-5136, refer to Japanese Patent Laid-open (Kokai) No. 56-35981)

*Corynebacterium glutamicum* H7684 (FERM BP-3004, refer to Japanese Patent Laid-open (Kokai) No. 04-88994)

*Brevibacterium lactofermentum* AJ11426 (FERM P-5123, refer to Japanese Patent Laid-open (Kokai) No. 56-048890)

*Corynebacterium glutamicum* AJ11440 (FERM P-5137, refer to Japanese Patent Laid-open (Kokai) No. 56-048890)

*Brevibacterium lactofermentum* AJ11796 (FERM P-6402, refer to Japanese Patent Laid-open (Kokai) No. 58-158192)

Furthermore, examples of methods for imparting or enhancing L-glutamic acid-producing ability to or in coryneform bacteria also include by enhancing expression of the yggB gene and introducing a mutant yggB gene having a mutation in the coding region (WO2006/070944). The yggB gene is a gene coding for a mechanosensitive channel. The yggB gene of the *Corynebacterium glutamicum* ATCC 13032 strain corresponds to the sequence complementary to the sequence of the nucleotide numbers 1,336,091 to 1,337,692 in the genome sequence registered as Genbank Accession No. NC_003450 in the NCBI database, and is also called NCgl1221. The YggB protein is registered as GenBank accession No. NP_600492. The nucleotide sequence of the yggB gene of *Corynebacterium glutamicum* 2256 (ATCC 13869) and the amino acid sequence of the YggB protein encoded by the gene are shown in SEQ ID NOS: 273 and 274, respectively.

Examples of the mutant yggB gene which can be used in the aforementioned methods include yggB genes having the following mutation(s). The YggB protein encoded by a mutant yggB gene is also referred to as a mutant YggB protein. A yggB gene not having such mutation(s) and the YggB protein encoded by the gene are also referred to as a wild-type yggB gene and wild-type YggB protein, respectively. Examples of the wild-type YggB protein include, for example, a protein having the amino acid sequence shown in SEQ ID NO: 274.

(1) Mutation on C-Terminal Side

The mutation on the C-terminal side is a mutation introduced into a part of the nucleotide sequence of the region coding for the sequence of the amino acid numbers 419 to 533 in SEQ ID NO: 274. Although the mutation on the C-terminal side is not particularly limited so long as a mutation is introduced into at least a part of the nucleotide sequence of the aforementioned region, the mutation on the C-terminal side can be a mutation for inserting an insertion sequence (henceforth also referred to as "IS") or inserting a transposon. The mutation on the C-terminal side may be any mutation that introduces an amino acid substitution (missense mutation), a mutation causing a frame shift induced by insertion of the aforementioned IS, or the like, and that introduces a nonsense mutation.

Examples of the mutation on the C-terminal side include, for example, a mutation for inserting a nucleotide sequence at the site coding for the valine residue at position 419 in the wild-type YggB protein (2A-1-type mutation). The 2A-1-type mutation may result in, for example, deletion or substitution of a part or the whole of amino acid residues at positions 419 to 533 of the wild-type YggB protein. Specific examples of the mutant yggB gene having the 2A-1-type mutation include, for example, a yggB gene inserted with IS next to "G" at position 1255 in SEQ ID NO: 273, and thereby coding for a mutant YggB protein of 423 amino residues in the full length, which is shorter than the native YggB protein (SEQ ID NO: 274) (Japanese Patent Laid-open (Kokai) No. 2007-222163).

Examples of the mutation on the C-terminal side can also include a mutation for replacing a proline residue present in positions 419 to 533 in the wild-type YggB protein with another amino acid residue. Examples of such a proline residue include those at positions 424, 437, 453, 457, 462, 469, 484, 489, 497, 515, 529, and 533 in the wild-type YggB protein.

(2) Mutation in Transmembrane Region

It is estimated that the YggB protein encoded by the yggB gene has five transmembrane regions. In the amino acid sequence of the wild-type YggB protein of SEQ ID NO: 274, the transmembrane regions correspond to the regions of the amino acid numbers 1 to 23 (first transmembrane region), 25 to 47 (second transmembrane region), 62 to 84 (third transmembrane region), 86 to 108 (fourth transmembrane region), and 110 to 132 (fifth transmembrane region). The yggB gene may have a mutation in any of these transmembrane regions. The mutation in the transmembrane region can be a mutation that includes substitution, deletion, addition, insertion, or inversion of one or several amino acid residues that does not cause a frame shift mutation or nonsense mutation. Examples of the mutation in the transmembrane region include a mutation for inserting one or several amino acid residues (e.g. Cys-Ser-Leu) between the leucine residue at position 14 and the tryptophan residue at position 15, a mutation for replacing the alanine residue at position 100 with another amino acid residue (e.g. an amino acid having a hydroxy group in the side chain thereof, i.e. Thr, Ser, or Tyr; preferably Thr), and a mutation for replacing the alanine residue at position 111 with another amino acid residue (e.g. an amino acid having a hydroxy group in the side chain thereof, i.e. Thr, Ser, or Tyr; preferably Thr), in the amino acid sequence shown in SEQ ID NO: 274, and so forth. Specific examples of the mutant yggB gene having such a mutation in transmembrane region include, for example, a yggB gene having the sequence TTCATTGTG inserted next to the "G" at position 44 in SEQ ID NO: 273 (A1-type mutation), a yggB gene in which the "G" at position 298 in SEQ ID NO: 273 is replaced with an "A" (19-type mutation), and a yggB gene in which the "C" at position 332 in SEQ ID NO: 273 is replaced with a "T" (L30-type mutation).

When the wild-type YggB protein has an amino acid sequence other than the amino acid sequence shown in SEQ ID NO: 274, the mutant yggB gene may have a mutation in a region coding for the amino acid residue corresponding to the amino acid residue at the aforementioned position in SEQ ID NO: 274. In an arbitrary wild-type YggB protein, the amino acid residue that is "the amino acid residue corresponding to the amino acid residue at the aforementioned position in SEQ ID NO: 274" can be determined based on an alignment between the amino acid sequence of the wild-type YggB protein and the amino acid sequence of SEQ ID NO: 274.

<L-Glutamine-Producing Microorganisms>

Examples of the method for imparting or enhancing L-glutamine-producing ability include, for example, a method of modifying a bacterium so that the activity or activities of one or more kinds of enzymes such as the L-glutamine biosynthesis enzymes are enhanced. Examples of such enzymes include, but are not particularly limited to, glutamate dehydrogenase (gdhA) and glutamine synthetase (glnA). The glutamine synthetase activity can also be enhanced by disruption of the glutamine adenylyltransferase gene (glnE) or disruption of the PII control protein gene (glnB) (EP 1229121).

Examples of the method for imparting or enhancing L-glutamine-producing ability also include, for example, a method of modifying a bacterium so that the activity or activities of one or more kinds of enzymes that catalyze a reaction branching away from the biosynthesis pathway of L-glutamine to generate a compound other than L-glutamine are reduced. Examples of such enzymes include, but not particularly limited to, glutaminase.

Examples of L-glutamine-producing bacteria and parent strains which can be used to derive them include coryneform bacteria in which the activity or activities of glutamate dehydrogenase (gdhA) and/or glutamine synthetase (glnA) (EP 1229121, EP 1424398) are enhanced, and coryneform bacteria in which the glutaminase activity (Japanese Patent Laid-open (Kokai) No. 2004-187684) is reduced. Also, examples of L-glutamic acid-producing bacteria and parent strains which can be used to derive them include a strain belonging to the genus *Escherichia* and having a mutant glutamine synthetase in which the tyrosine residue of the position 397 is replaced with another amino acid residue (U.S. Patent Published Application No. 2003/0148474).

Examples of the methods for imparting or enhancing L-glutamine-producing ability to or in coryneform bacteria also include the method of imparting 6-diazo-5-oxo-norleucine resistance (Japanese Patent Laid-open (Kokai) No. 3-232497), the method of imparting purine analogue resistance and methionine sulfoxide resistance (Japanese Patent Laid-open (Kokai) No. 61-202694), the method of imparting α-ketomalonic acid resistance (Japanese Patent Laid-open (Kokai) No. 56-151495), and so forth.

Specific examples of coryneform bacteria having L-glutamine-producing ability include, for example, the following strains.

Brevibacterium flavum AJ11573 (FERM P-5492, Japanese Patent Laid-open (Kokai) No. 56-151495)

Brevibacterium flavum AJ11576 (FERM BP-10381, Japanese Patent Laid-open (Kokai) No. 56-151495)

Brevibacterium flavum AJ12212 (FERM P-8123, Japanese Patent Laid-open (Kokai) No. 61-202694)

<L-Proline-Producing Microorganisms>

Examples of L-proline-producing bacteria and parent strains which can be used to derive them include bacteria having γ-glutamyl kinase desensitized to feedback inhibition by L-proline and bacteria in which the L-proline decomposition system is attenuated. A method for modifying a bacterium by using a DNA encoding γ-glutamyl kinase desensitized to feedback inhibition by L-proline is disclosed in the report of Dandekar and Uratsu (J. Bacteriol. 170, 12: 5943-5945 (1988)). Also, examples of a method for obtaining a bacterium in which the L-proline decomposition system is attenuated include, for example, methods of introducing a mutation into a proline dehydrogenase gene so that the activity of the encoded enzyme is reduced. Specific examples of bacteria having L-proline-producing ability include E. coli NRRL B-12403 and NRRL B-12404 (British Patent No. 2075056), E. coli VKPM B-8012 (Russian Patent Application No. 2000124295), E. coli mutant strains having a plasmid described in German Patent No. 3127361, and E. coli mutant strains having a plasmid described by Bloom F. R. et al. (The 15th Miami winter symposium, 1983, p. 34).

Also, specific examples of bacteria having L-proline-producing ability include E. coli 702 strain (VKPM B-8011), which is a 3,4-dehydroxyproline and azetidine-2-carboxylate resistant strain, E. coli 702ilvA strain (VKPM B-8012), which is an ilvA gene-deficient strain of the 702 strain, and E. coli strains in which the activity of a protein encoded by b2682, b2683, b1242, or b3434 gene (Japanese Patent Laid-open (Kokai) No. 2002-300874) is enhanced.

<L-Arginine-Producing Microorganisms>

Examples of methods for imparting or enhancing L-arginine-producing ability include, for example, a method of modifying a microorganism so that the microorganism has an increased activity or activities of one or more kinds of enzymes such as the L-arginine biosynthesis enzymes. Examples of such enzymes include, but are not particularly limited to, N-acetylglutamate synthase (argA), N-acetylglutamyl phosphate reductase (argC), ornithine acetyl transferase (argJ), N-acetylglutamate kinase (argB), acetylornithine transaminase (argD), acetylornithine deacetylase (argE), ornithine carbamoyl transferase (argF), argininosuccinate synthetase (argG), argininosuccinate lyase (argH), and carbamoyl phosphate synthetase (carAB). As the N-acetylglutamate synthase gene (argA), for example, a gene encoding a mutant enzyme desensitized to feedback inhibition by L-arginine by substitution for the amino acid sequence corresponding to the positions 15 to 19 of the wild-type enzyme (European Patent Laid-open No. 1170361) can be used.

Examples of a microorganism having an L-arginine-producing ability include Escherichia coli mutant strains having resistance to α-methylmethionine, p-fluorophenylalanine, D-arginine, arginine hydroxamate, S-(2-aminoethyl)-cysteine, α-methylserine, β-2-thienylalanine, or sulfaguanidine (refer to Japanese Patent Laid-open (Kokai) No. 56-106598), and so forth. Examples of a microorganism having an L-arginine-producing ability also include the E. coli 237 strain (Russian Patent Application No. 2000117677), which is an L-arginine-producing bacterium harboring N-acetyl glutamate synthase having a mutation resistant to feedback inhibition by L-arginine and thereby having a high activity. The E. coli 237 strain was deposited at the Russian National Collection of Industrial Microorganisms (VKPM, 1 Dorozhny proezd., 1 Moscow 117545, Russia) on Apr. 10, 2000 under an accession number of VKPM B-7925, and the deposit was converted to an international deposit under the provisions of Budapest Treaty on May 18, 2001. Examples of a microorganism having L-arginine-producing ability also include the E. coli 382 strain (Japanese Patent Laid-open (Kokai) No. 2002-017342), which is an L-arginine-producing bacterium derived from the 237 strain and having an improved acetic acid-assimilating ability. The E. coli 382 strain was deposited at the Russian National Collection of Industrial Microorganisms (VKPM, 1 Dorozhny proezd., 1 Moscow 117545, Russia) on Apr. 10, 2000 under accession number of VKPM B-7926.

Examples of a microorganism having L-arginine-producing ability also include, coryneform bacterium wild-type strains; the coryneform bacterium strains having resistance to a drug such as sulfa drugs, 2-thiazolealanine, and α-amino-β-hydroxy valerate; the coryneform bacterium strains having resistance to 2-thiazolealanine and further exhibiting auxotrophy for L-histidine, L-proline, L-threonine, L-isoleucine, L-methionine, or L-tryptophan (Japanese Patent Laid-open (Kokai) No. 54-44096); coryneform bacterium strains resistant to ketomalonic acid, fluoromalonic acid, or monofluoroacetic acid (Japanese Patent Laid-open (Kokai) No. 57-18989); coryneform bacterium strains resistant to argininol (Japanese Patent Publication No. 62-24075); coryneform bacterium strains resistant to X-guanidine (X represents an aliphatic chain or a derivative thereof, Japanese Patent Laid-open (Kokai) No. 2-186995); and so forth. Examples of coryneform bacteria having L-arginine-producing ability also include mutant strains resistant to 5-azauracil, 6-azauracil, 2-thiouracil, 5-fluorouracil, 5-bromo-uracil, 5-azacytosine, 6-azacytosine, etc; mutant strains resistant to arginine hydroxamate and 2-thiouracil; mutant strains resistant to arginine hydroxamate and 6-azauracil (Japanese Patent Laid-open (Kokai) No. 49-126819); mutant strains resistant to histidine analog or tryptophan analog (Japanese Patent Laid-open (Kokai) No. 52-114092); mutant strains resistant to at least one of methionine, histidine, threonine, proline, isoleucine, lysine, adenine, guanine, and uracil (or uracil precursor) (Japanese Patent Laid-open (Kokai) No. 52-99289); mutant strains resistant to arginine hydroxamate (Japanese published examined application No. 51-6754); mutant strains auxotrophic for succinate or resistant to nucleic acid base analogs (Japanese Patent Laid-open (Kokai) No. 58-9692); mutant strains deficient in arginine decomposition ability, having resistant to arginine antagonist and canavanine, and auxotrophic for lysine (Japanese Patent Laid-open (Kokai) No. 52-8729); mutant strains resistant to arginine, arginine hydroxamate, homoarginine, D-arginine, and canavanine, or resistant to arginine hydroxamate and 6-azauracil (Japanese Patent Laid-open (Kokai) No. 53-143288); mutant strains resistant to canavanine (Japanese Patent Laid-open (Kokai) No. 53-3586), and so forth.

Specific examples of coryneform bacteria having L-arginine-producing ability include the following strains.

Corynebacterium glutamicum (Brevibacterium flavum) AJ11169 (FERM BP-6892)

Brevibacterium lactofermentum AJ12092 (FERM BP-6906)

Brevibacterium flavum AJ11336 (FERM BP-6893)

Brevibacterium flavum AJ11345 (FERM BP-6894)

Brevibacterium lactofermentum AJ12430 (FERM BP-2228)

Examples of L-arginine-producing bacteria and parent strains which can be used to derive them also include strains deficient in ArgR, which is an arginine repressor (U.S. Patent Published Application No. 2002-0045223), and strains in which intracellular glutamine synthetase activity is increased (U.S. Patent Published Application No. 2005-0014236).

<L-Citrulline-Producing Bacteria and L-Ornithine-Producing Microorganisms>

The biosynthetic pathways of L-citrulline and L-ornithine are common to that of L-arginine. Therefore, an ability to produce L-citrulline and/or L-ornithine can be imparted or enhanced by increasing the activity or activities of N-acetylglutamate synthase (argA), N-acetylglutamyl phosphate reductase (argC), ornithine acetyltransferase (argJ), N-acetylglutamate kinase (argB), acetylornithine transaminase (argD), and/or acetylornithine deacetylase (argE) (WO2006/35831).

<L-Leucine-Producing Microorganisms>

Examples of methods for imparting or enhancing L-leucine-producing ability include, for example, a method of modifying a microorganism so that the microorganism has an increased activity or activities of one or more kinds of enzymes such as the L-leucine biosynthesis enzymes. Examples of such enzymes include, but not particularly limited to, the enzymes encoded by the genes of the leuABCD operon. For enhancing the activity of such an enzyme, for example, the mutant leuA gene coding for an isopropyl maleate synthase desensitized to feedback inhibition by L-leucine (U.S. Pat. No. 6,403,342) can be used.

Examples of L-leucine-producing bacteria and parent strains which can be used to derive them include, but are not limited to, strains belonging to the genus Escherichia, such as E. coli strains resistant to leucine (for example, the 57 strain (VKPM B-7386, U.S. Pat. No. 6,124,121)), E. coli strains resistant to an leucine analogue such as β-2-thienylalanine, 3-hydroxyleucine, 4-azaleucine, and 5,5,5-trifluoroleucine (Japanese Patent Publication (Kokoku) No. 62-34397 and Japanese Patent Laid-open (Kokai) No. 8-70879), E. coli strains obtained by a gene engineering technique described in WO96/06926, and E. coli H-9068 (Japanese Patent Laid-open (Kokai) No. 8-70879). Furthermore, examples of coryneform bacteria having L-leucine-producing ability include Brevibacterium lactofermentum AJ3718 (FERM P-2516), which is resistant to 2-thiazole alanine and β-hydroxyleucine and auxotrophic for isoleucine and methionine.

<L-Isoleucine-Producing Microorganisms>

Examples of L-isoleucine-producing bacteria and parent strains which can be used to derive them include, but are not limited to, mutant strains having resistance to 6-dimethylaminopurine (Japanese Patent Laid-open (Kokai) No. 5-304969), mutant strains having resistance to an isoleucine analogue such as thiaisoleucine and isoleucine hydroxamate, and mutant strains having resistance to such an isoleucine analogue and further having resistance to DL-ethionine and/or arginine hydroxamate (Japanese Patent Laid-open (Kokai) No. 5-130882). Also, a recombinant strain transformed with a gene encoding a protein involved in L-isoleucine biosynthesis such as threonine deaminase and acetohydroxy acid synthase can be used as a parent strain (Japanese Patent Laid-open (Kokai) No. 2-458, FR 0356739, U.S. Pat. No. 5,998,178). Furthermore, examples of coryneform bacteria having L-isoleucine-producing ability include the coryneform bacterium in which brnE gene coding for a branched chain amino acid excretion protein is amplified (Japanese Patent Laid-open (Kokai) No. 2001-169788), the coryneform bacterium to which L-isoleucine-producing ability is imparted by protoplast fusion with an L-lysine-producing bacterium (Japanese Patent Laid-open (Kokai) No. 62-74293), the coryneform bacterium in which homoserine dehydrogenase is enhanced (Japanese Patent Laid-open (Kokai) No. 62-91193), the threonine hydroxamate resistant strain (Japanese Patent Laid-open (Kokai) No 62-195293), the α-ketomalonic acid resistant strain (Japanese Patent Laid-open (Kokai) No. 61-15695), the methyllysine resistant strain (Japanese Patent Laid-open (Kokai) No. 61-15696), and Brevibacterium flavum AJ12149 (FERM BP-759, U.S. Pat. No. 4,656,135).

<L-Valine-Producing Microorganisms>

Examples of methods for imparting or enhancing L-valine-producing ability include, for example, a method of modifying a microorganism so that the microorganism has an increased activity or activities of one or more kinds of enzymes such as the L-valine biosynthesis enzymes. Examples of such enzymes include, but are not particularly limited to, the enzymes encoded by the genes of the ilvGMEDA operon. Expression of the ilvGMEDA operon is suppressed (attenuated) by L-valine, L-isoleucine, and/or L-leucine. Therefore, to enhance the activity of such an enzyme, suppressing the expression by the produced L-valine is inhibited by removing or modifying a region required for the attenuation. Furthermore, the threonine deaminase encoded by the ilvA gene is an enzyme that catalyzes the deamination reaction of L-threonine resulting 2-ketobutyric acid, which is the rate-limiting step of the L-isoleucine biosynthesis system. Therefore, for L-valine production, the ilvA gene can be, for example, disrupted, and thereby the threonine deaminase activity is decreased.

Specific examples of L-valine-producing bacteria and parent strains which can be used to derive them include, for example, E. coli strains modified so as to overexpress the ilvGMEDA operon (U.S. Pat. No. 5,998,178).

Examples of L-valine-producing bacteria and parent strains which can be used to derive them also include mutant strains having a mutation in amino-acyl t-RNA synthetase (U.S. Pat. No. 5,658,766). Examples of such strains include, for example, E. coli VL1970, which has a mutation in the ileS gene encoding isoleucine t-RNA synthetase. E. coli VL1970 was deposited at the Russian National Collection of Industrial Microorganisms (VKPM, 1 Dorozhny Proezd, 1 Moscow 117545, Russia) on Jun. 24, 1988 under the accession number of VKPM B-4411. Examples of L-valine-producing bacteria and parent strains which can be used to derive them also include mutant strains requiring lipoic acid for growth and/or lacking $H^+$-ATPase (WO96/06926).

Examples of coryneform bacteria having L-valine-producing ability include, for example, strains modified so that the expression of gene encoding an enzyme involved in biosynthesis of L-valine is increased. Examples of the enzyme involved in biosynthesis of L-valine include, for example, enzymes encoded by ilvBNC operon, i.e. acetohydroxy acid synthase encoded by ilvBN and isomeroreductase encoded by ilvC (WO00/50624). Because the ilvBNC operon is subject to expression regulation of the operon by L-valine, L-isoleucine, and/or L-leucine, it is preferred that the attenuation is inhibited in order to inhibit the suppression of expression by the produced L-valine.

Examples of coryneform bacteria having L-valine-producing ability include, for example, strains modified so that the activity or activities of one or more kinds of enzymes such as enzymes involved in metabolic pathway that decreases L-valine production are reduced. Examples of such enzymes include, for example, threonine dehydratase involved in the L-leucine synthesis, and the enzymes involved in the D-pantothenic acid synthesis (WO00/50624).

Examples of L-valine-producing bacteria and parent strains which can be used to derive them also include strains resistant to an amino acid analogue or the like. Examples of such strains include, for example, the coryneform bacterium strains which are auxotrophic for L-isoleucine and L-methionine, and resistant to D-ribose, purine ribonucleoside, or pyrimidine ribonucleoside, and have an ability to produce L-valine (FERM P-1841, FERM P-29) (Japanese Patent Publication No. 53-025034), coryneform bacterium strains resistant to polyketides (FERM P-1763, FERM P-1764) (Japanese Patent Publication No. 06-065314), and coryneform bacterium strains resistant to L-valine in a medium containing acetic acid as the sole carbon source and sensitive to pyruvic acid analogues (fluoropyruvic acid etc.) in a medium containing glucose as the sole carbon source (FERM BP-3006, BP-3007) (Japanese Patent No. 3006929).

<L-Cysteine-Producing Microorganisms>

Examples of methods for imparting or enhancing L-cysteine-producing ability include, for example, a method of modifying a bacterium so that the bacterium has an increased activity or activities of one or more kinds of enzymes such as the L-cysteine biosynthesis enzymes. Examples of such enzymes include, but are not particularly limited to, serine acetyltransferase (cysE) and 3-phosphoglycerate dehydrogenase (serA). The serine acetyltransferase activity can be enhanced by, for example, introducing a mutant cysE gene coding for a mutant serine acetyltransferase resistant to feedback inhibition by cysteine into a bacterium. Such a mutant serine acetyltransferase is disclosed in, for example, Japanese Patent Laid-open (Kokai) No. 11-155571 and U.S. Patent Published Application No. 20050112731. Furthermore, the 3-phosphoglycerate dehydrogenase activity can be enhanced by, for example, introducing a mutant serA gene coding for a mutant 3-phosphoglycerate dehydrogenase resistant to feedback inhibition by serine into a bacterium. Such a mutant 3-phosphoglycerate dehydrogenase is disclosed in, for example, U.S. Pat. No. 6,180,373.

Furthermore, examples of methods for imparting or enhancing L-cysteine-producing ability also include, for example, a method of modifying a bacterium so that the bacterium has a reduced activity or activities of one or more kinds of enzymes such as the enzymes that catalyze a reaction branching away from the biosynthesis pathway of L-cysteine to generate a compound other than L-cysteine. Examples of such enzymes include, for example, enzymes involved in decomposition of L-cysteine. Examples of the enzymes involved in decomposition of L-cysteine include, but are not particularly limited to, cystathionine-β-lyase (metC, Japanese Patent Laid-open (Kokai) No. 11-155571; Chandra et al., Biochemistry, 21 (1982) 3064-3069), tryptophanase (tnaA, Japanese Patent Laid-open (Kokai) No. 2003-169668; Austin Newton et al., J. Biol. Chem., 240 (1965) 1211-1218), O-acetylserine sulfhydrylase B (cysM, Japanese Patent Laid-open (Kokai) No. 2005-245311), the malY gene product (Japanese Patent Laid-open (Kokai) No. 2005-245311), the d0191 gene product of *Pantoea ananatis* (Japanese Patent Laid-open (Kokai) No. 2009-232844), and cysteine desulfhydrase (aecD) (Japanese Patent Laid-open (Kokai) No. 2002-233384).

Furthermore, examples of methods for imparting or enhancing L-cysteine-producing ability also include, for example, a method of enhancing the L-cysteine excretory system, and a method of enhancing the sulfate/thiosulfate transport system. Examples of proteins of the L-cysteine excretory system include the protein encoded by the ydeD gene (Japanese Patent Laid-open (Kokai) No. 2002-233384), the protein encoded by the yfiK gene (Japanese Patent Laid-open (Kokai) No. 2004-49237), the proteins encoded by the emrAB, emrKY, yojIH, acrEF, bcr, and cusA genes (Japanese Patent Laid-open (Kokai) No. 2005-287333), and the protein encoded by the yeaS gene (Japanese Patent Laid-open (Kokai) No. 2010-187552). Examples of the proteins of the sulfate/thiosulfate transport system include the proteins encoded by the cysPTWAM gene cluster.

Specific examples of L-cysteine-producing bacteria and parent strains which can be used to derive them include, for example, *E. coli* JM15 transformed with different cysE alleles coding for feedback-resistant serine acetyltransferases (U.S. Pat. No. 6,218,168, Russian patent application 2003121601), *E. coli* W3110 having an over-expressed gene encoding a protein which promotes secretion of a cytotoxic substance (U.S. Pat. No. 5,972,663), *E. coli* strains having a reduced cysteine desulfohydrase activity (JP11155571A2), and *E. coli* W3110 having an increased activity of a positive transcriptional regulator for cysteine regulon encoded by the cysB gene (WO0127307A1).

Furthermore, examples of coryneform bacteria having L-cysteine-producing ability include, for example, coryneform bacteria having serine acetyltransferase desensitized to feedback inhibition by L-cysteine thereby to show enhanced intracellular serine acetyltransferase activity (Japanese Patent Laid-open (Kokai) No. 2002-233384).

<L-Serine-Producing Microorganisms>

Examples of methods for imparting or enhancing L-serine-producing ability include, for example, a method of modifying a bacterium so that the bacterium has an increased activity or activities of one or more kinds of enzymes such as the L-serine biosynthesis enzymes (Japanese Patent Laid-open (Kokai) No. 11-253187). Examples of such enzymes include, but are not particularly limited to, 3-phosphoglycerate dehydrogenase (serA), phosphoserine transaminase (serC), and phosphoserine phosphatase (serB) (Japanese Patent Laid-open (Kokai) No. 11-253187). 3-phosphoglycerate dehydrogenase activity can be enhanced by, for example, introducing a mutant serA gene encoding a mutant 3-phosphoglycerate dehydrogenase resistant to feedback inhibition by serine. The mutant 3-phosphoglycerate dehydrogenase is disclosed in, for example, U.S. Pat. No. 6,180,373.

Examples of L-serine-producing bacteria and parent strains which can be used to derive them include, for example, coryneform bacteria having resistance to azaserine or β-(2-thienyl)-DL-alanine, and deficient in L-serine decomposition ability (Japanese Patent Laid-open (Kokai)

No. 11-253187). Specific examples of such coryneform bacteria include, for example, *Brevibacterium flavum* AJ13324 (FERMP-16128), which has resistance to azaserine and is deficient in L-serine decomposition ability, and *Brevibacterium flavum* AJ13325 (FERM P-16129), which has resistance to β-(2-thienyl)-DL-alanine and is deficient in L-serine decomposition ability (Japanese Patent Laid-open (Kokai) No. 10-248588).

<Isopropyl Alcohol-Producing Microorganisms>

Microorganisms having an ability to produce isopropyl alcohol have been described in detail in WO2013/018734A1.

Examples of a method to impart or increase an ability to produce isopropyl alcohol include, for example, a method of modifying a microorganism to have an increased activity of one or more enzymes such as isopropyl alcohol biosynthesis enzymes. Examples of such enzymes include, but are not particularly limited to, acetoacetate decarboxylase, isopropyl alcohol dehydrogenase, CoA-transferase, and thiolase (WO2009/008377A1). In particular, the activities of all four of these enzymes can be increased.

Moreover, examples of a method to impart or increase an ability to produce isopropyl alcohol include, for example, a method of modifying a microorganism to have a reduced activity of GntR (gntR). GntR refers to a transcription factor which negatively regulates the expression of an operon encoding gluconate metabolic genes. Specifically, the operon encodes gluconate uptake system and gluconate phosphorylase. For example, there are two gluconate metabolic systems, GntI and GntII in *Escherichia coli*, and GntR suppresses the expression of both of them.

Moreover, in addition to the reduced activity of GntR, the microorganism may be further modified to have an increased or reduced activity of one or more enzymes such as other enzymes that can affect an ability to produce isopropyl alcohol when the activity of GntR is reduced. Such an enzyme is also referred to as "auxiliary enzyme". Examples of the auxiliary enzyme include glucose-6-phosphate isomerase (pgi), glucose-6-phosphate-1-dehydrogenase (Zwf), and phosphogluconate dehydrogenase (Gnd). Altered patterns in these enzyme activities are not particularly limited as long as an increased production due to a reduced activity of GntR is retained or increased further.

Examples of the altered pattern in enzymatic activities of the auxiliary enzymes can include the patterns below:

(1) retained wild-type activities of glucose-6-phosphate isomerase (pgi), glucose-6-phosphate-1-dehydrogenase (Zwf) and phosphogluconate dehydrogenase (Gnd);

(2) reduced activity of glucose-6-phosphate isomerase (pgi) and increased activity of glucose-6-phosphate-1-dehydrogenase (Zwf);

(3) reduced activity of glucose-6-phosphate isomerase (pgi), and increased activity of glucose-6-phosphate-1-dehydrogenase (Zwf), and reduced activity of phosphogluconate dehydrogenase (Gnd).

Among these patterns, the enzyme activity pattern of the auxiliary enzyme group in the above-described (3) is a particular example in terms of the ability to produce isopropyl alcohol.

Glucose-6-phosphate isomerase (pgi) refers to a generic name of an enzyme that corresponds to the enzyme number 5.3.1.9 based on the report of the Enzyme Committee of the International Union of Biochemistry (I. U. B.), and catalyzes a reaction to produce D-fructose-6-phosphate from D-glucose-6-phosphate Glucose-6-phosphate-1-dehydrogenase (Zwf) refers to a generic name of an enzyme that corresponds to the enzyme number 1.1.1.49 based on the report of the Enzyme Committee of the International Union of Biochemistry (I. U. B.), and catalyzes a reaction to produce D-glucono-1,5-lactone-6-phosphate from D-glucose-6-phosphate.

Phosphogluconate dehydrogenase (Gnd) refers to a generic name of an enzyme that corresponds to the enzyme number 1.1.1.44 based on the report of the Enzyme Committee of the International Union of Biochemistry (I. U. B.), and catalyzes a reaction to produce D-ribulose-5-phosphate and $CO_2$ from 6-phospho-D-gluconate.

Examples of the glucose-6-phosphate-1-dehydrogenase (Zwf) gene include the Zwf genes derived from *Deinococcus* bacteria such as *Deinococcus radiophilus*, *Acetobacter* bacteria such as *Acetobacter hansenii*, *Thermotoga* bacteria such as *Thermotoga maritima*, *Pseudomonas* bacteria such as *Pseudomonas fluorescens* and *Pseudomonas aeruginos*, *Bacillus* bacteria such as *Bacillus megaterium*, *Escherichia* bacteria such as *Escherichia coli*, *Aspergillus* fungi such as *Aspergillus niger* and *Aspergillus aculeatus*, *Cryptococcus* fungi such as *Cryptococcus neoformans*, *Dictyostelium* fungi such as *Dictyostelium discoideum*, and *Saccharomyces* yeasts such as *Saccharomyces cerevisiae*. Particular examples include glucose-6-phosphate-1-dehydrogenase (Zwf) gene include the Zwf genes derived from *Deinococcus* bacteria, *Acetobacter* bacteria, *Thermotoga* bacteria, *Pseudomonas* bacteria, *Bacillus* bacteria, *Escherichia* bacteria, and *Aspergillus* fungi, and the Zwf gene derived from *Escherichia coli* is a particular example.

A microorganism having an ability to produce isopropyl alcohol may have been modified to have a reduced lactate dehydrogenase activity. Such a modification inhibits the production of lactic acid and allows the microorganism to produce isopropyl alcohol in an efficient manner even under a culture condition in which oxygen supply is limited. The culture condition in which oxygen supply is limited generally refers to a condition which includes 0.02 vvm to 2.0 vvm (vvm; ventilation volume [mL]/liquid volume [mL]/time [minute]) and a revolution number of 200 to 600 rpm when only air is used as a gas.

Examples of a microorganism having an ability to produce isopropyl alcohol can include, for example, the *Escherichia coli* pIPA/B strain and the pIaaa/B strain described in WO2009/008377, which have increased activities of acetoacetate decarboxylase, isopropyl alcohol dehydrogenase, CoA-transferase, and thiolase and can produce isopropyl alcohol from plant-derived raw materials; and the like. Moreover, examples of a microorganism having an ability to produce isopropyl alcohol also include, for example, the *Escherichia coli* pIa/B::atoDAB strain described in WO2009/008377, which has increased activities of CoA-transferase and thiolase due to increased expression of the corresponding genes on the genome and has increased activities of isopropyl alcohol dehydrogenase and acetoacetate decarboxylase due to the introduction of plasmids carrying the corresponding genes. Other examples of a microorganism having an ability to produce isopropyl alcohol include, for example, the *Escherichia coli* strains described in WO2009/094485 and WO2009/046929.

<Acetone-Producing Microorganisms>

Acetone is a precursor of isopropyl alcohol in isopropyl alcohol production. Accordingly, an ability to produce acetone can be imparted or increased by utilizing a part of the methods to impart or increase an ability to produce isopropyl alcohol. For example, an ability to produce acetone can be imparted or increased by modifying a microorganism to have an increased activity of one or more enzymes such as the above-indicated isopropyl alcohol biosynthesis enzymes except for isopropyl alcohol dehydrogenase, that is, acetoacetate decarboxylase, CoA-transferase, and thiolase.

<Ethanol-Producing Microorganisms>

Examples of a microorganism having an ability to produce ethanol include, for example, *Saccharomyces* yeasts as well as bacteria belonging to the genera *Acinetobacter, Gluconobacter, Zymomonas, Escherichia, Geobacter, Shewanella, Salmonella, Enterobacter, Klebsiella, Bacillus, Clostridium, Corynebacterium, Lactobacillus, Lactococcus, Oenococcus, Streptococcus*, and *Eubacterium*. Moreover, a method for producing recombinant microorganisms having an ability to produce ethanol is known in the art of molecular biology (U.S. Pat. Nos. 7,026,152; 6,849,434; 6,333,181; 5,821,093; 5,482,846; 5,424,202; 5,028,539; 5,000,000; 5,487,989; 5,554,520; and 5,162,516; and WO2003/025117). Moreover, examples of a microorganism having an ability to produce ethanol include a *Corynebacterium glutamicum* mutant strain in which the lactate dehydrogenase gene (ldhA) has been deleted and the pyruvate decarboxylase gene (pdc) and the alcohol dehydrogenase gene (adhB) from *Zymomonas mobilis* have been introduced, and the same mutant strain except that the phosphoenolpyruvate carboxylase gene (ppc) has been further deleted (J Mol Microbiol Biotechnol 2004, 8, 243-254). Moreover, examples of a microorganism having an ability to produce ethanol also include the *E. coli* strain KO11 in which the pyruvate formate lyase gene (pfl) and the fumarate reductase gene (frd) have been deleted and the pyruvate decarboxylase gene (pdc) and the alcohol dehydrogenase gene (adhB) from *Zymomonas mobilis* have been introduced (Ann N Y Acad Sci. 2008, 1125, 363-372).

<1,3-Propanediol-Producing Microorganisms>

Examples of a microorganism having an ability to produce 1,3-propanediol include, for example, bacteria belonging to the genera *Escherichia, Klebsiella, Clostridium*, and *Lactobacillus*. The microorganism having an ability to produce 1,3-propanediol can have, for example, (a) at least one gene encoding a glycerol dehydratase reactivation factor, (b) at least one gene encoding a glycerol dehydratase reactivation factor, and (c) at least one gene encoding a non-specific catalytic activity to convert 3-hydroxypropionaldehyde into 1,3-propanediol. Moreover, the 1,3-propanediol-producing strain of the genus *Clostridium* can be a strain in which at least one heterogeneous gene encoding an enzyme involved in the B-12-independent 1,3-propanediol pathway has been introduced. Examples of such a gene include the dhaB1 gene, the dhaB2 gene, and the dhaT gene. As a microorganism having an ability to produce 1,3-propanediol, for example, microorganisms indicated in Japanese Translation of PCT International Application Publication No. 2010-508013 are available.

<Organic Acids-Producing Microorganisms>

Examples of microorganisms having an ability to produce acetic acid, 3-hydroxybutyric acid, polyhydroxybutyric acid, itaconic acid, citric acid, and/or butyric acid include, for example, microorganisms described in Enzyme Handbook (Kyoritsu Shuppan Co., Ltd). Examples of a microorganism having an ability to produce 3-hydroxyisobutyric acid include, for example, microorganisms into which a pathway described in WO2009/135074 or WO2008/145737 is introduced. Examples of a microorganism having an ability to produce 2-hydroxyisobutyric acid include, for example, microorganisms into which a pathway described in WO2009/135074 or WO2009/156214 is introduced. Examples of microorganism having an ability to produce each of 3-aminoisobutyric acid and methacrylic acid include, for example, microorganisms into which a pathway described in WO2009/135074 is introduced. Examples of a microorganism having an ability to produce 6-aminocaproic acid include, for example, microorganisms into which a pathway described in WO2012/177721 is introduced.

<Microorganisms Producing Other Objective Substance>

Examples of a microorganism having an ability to produce propylene include, for example, microorganisms into which a pathway described in US2012-0329119 is introduced. Examples of a microorganism having an ability to produce isoprene include, for example, microorganisms into which a pathway described in WO2013179722 is introduced. That is, examples of a microorganism having an ability to produce isoprene include, for example, microorganisms in which the isoprene synthase activity is increased. Such a microorganism having an ability to produce isoprene may be a microorganism in which, for example, the biosynthesis pathway for dimethylallyl pyrophosphate (such as mevalonate pathway and methylerythritol phosphate pathway), which is a substrate of isoprene synthase, is further enhanced. Examples of a microorganism having an ability to produce 1,3-butanediol include, for example, microorganisms into which a pathway described in WO2012/177619 is introduced. Examples of a microorganism having an ability to produce 1,4-butanediol include, for example, microorganisms described in Japanese Patent Application Publication No. Sho-62-285779. Examples of microorganisms having an ability to produce each of 1-propanol, 1,3-propanediol, and 1,2-propanediol include, for example, microorganisms into which a pathway described in WO2012/177599 is introduced. Examples of a microorganism having an ability to produce ethylene glycol include, for example, microorganisms into which a pathway described in WO2012/177983 is introduced. Examples of a microorganism having an ability to produce isobutanol include, for example, microorganisms into which a pathway described in WO2012/177601 is introduced.

Moreover, a microorganism having an objective substance-producing ability may have been modified to have an increased activity of protein(s) involved in glycometabolism and/or energy metabolism. The activities of these proteins can be increased, for example, by increasing the expression of genes encoding these proteins.

Examples of the proteins involved in the glycometabolism include proteins involved in uptake of saccharides and the glycolysis system enzymes. Examples of genes coding for a protein involved in the glycometabolism include glucose-6-phosphate isomerase gene (pgi, WO01/02542), phosphoenolpyruvate synthase gene (pps, European Patent Laid-open No. 877090), phosphoenolpyruvate carboxylase gene (ppc, WO95/06114), pyruvate carboxylase gene (pyc, WO99/18228, European Patent Laid-open No. 1092776), phosphoglucomutase gene (pgm, WO03/04598), fructose bisphosphate aldolase gene (pfkB, fbp, WO03/04664), pyruvate kinase gene (pykF, WO03/008609), transaldolase gene (talB, WO03/008611), fumarase gene (fum, WO01/02545), non-PTS sucrose uptake gene (csc, European Patent Laid-open No. 149911), and sucrose assimilation gene (scrAB operon, WO90/04636).

Examples of genes encoding the proteins involved in the energy metabolism include the transhydrogenase gene (pntAB, U.S. Pat. No. 5,830,716) and cytochrome bo-type oxidase gene (cyoB, European Patent Laid-open No. 1070376).

Moreover, when glycerol is used as a carbon source, for increasing the ability to assimilate glycerol, a microorganism having an objective substance-producing ability may have been modified so that the expression of the glpR gene is attenuated (EP1715056) or the expression of genes involved in glycerol metabolism, such as the glpA, glpB, glpC, glpD, glpE, glpF, glpG, glpK, glpQ, glpT, glpX, tpiA, gldA, dhaK, dhaL, dhaM, dhaR, fsa and talC genes (EP1715055A), is increased.

Moreover, a microorganism having an objective substance-producing ability may have been modified to have an increased activity to export the objective substance from cells of the microorganism. The activity to export an objective substance can be increased, for example, by increasing the expression of a gene encoding a protein for the export of the objective substance. For example, examples of genes encoding proteins for the export of various amino acids include the b2682 gene and the b2683 gene (ygaZH gene) (EP 1239041 A2).

The genes used for the breeding of the aforementioned objective substance-producing microorganisms are not limited to the genes exemplified above and genes having a known nucleotide sequence, and may be variants thereof, so long as they encode proteins of which the original functions are maintained. For example, the genes used for the breeding of the objective substance-producing microorganisms may be a gene coding for a protein having an amino acid sequence of a known protein, but include substitution, deletion, insertion, or addition of one or several amino acid residues at one or several positions. For the variants of genes and proteins, the descriptions for variants of dicarboxylic acid exporter proteins and genes encoding the exporter proteins mentioned later can be applied, mutatis mutandis.

<1-2> Reduction in the Dicarboxylic Acid Exporter Protein Activity

The microorganism of the present invention has been modified so that the activity of a dicarboxylic acid exporter protein is reduced. The microorganism of the present invention can be obtained by modifying a microorganism having an objective substance-producing ability as described above so that the activity of a dicarboxylic acid exporter protein is reduced. Moreover, the microorganism of the present invention can also be obtained by modifying a microorganism so that the activity of a dicarboxylic acid exporter protein is reduced and subsequently imparting or enhancing an objective substance-producing ability. Additionally, the microorganism of the present invention may be a microorganism which has acquired an objective substance-producing ability because of the modification to reduce the dicarboxylic acid exporter protein activity. The modification to establish the microorganism of the present invention may be performed in an arbitrary order.

The term "dicarboxylic acid exporter protein" refers to a protein having an activity to export a dicarboxylic acid having four or five carbon atoms ($C_4$-$C_5$ dicarboxylic acid). Examples of a $C_4$-$C_5$ dicarboxylic acid include, for example, malic acid, fumaric acid, succinic acid, 2-hydroxyglutaric acid (also referred to as α-hydroxyglutaric acid), and α-ketoglutaric acid (also referred to as 2-oxoglutaric acid).

The dicarboxylic acid exporter protein activity can be reduced by disrupting a gene encoding the same protein, and the like. Detailed procedures to reduce the activity of the protein will be described below. Examples of a gene encoding a dicarboxylic acid exporter protein include, for example, the yjjP gene, the yjjB gene, the yeeA gene, the ynfM gene, and the sucE1 gene.

<The yjjP Gene>

The yjjP gene is a gene encoding a protein that is predicted to be an inner membrane structural protein. The yjjP gene in the *Escherichia coli* strain MG1655 is also referred to as b4364 or ECK4354. The nucleotide sequence of the yjjP gene in the *Escherichia coli* strain MG1655 is shown in SEQ ID NO: 157 and the amino acid sequence of the protein (GenBank Accession No NP_418784.4) encoded by the same gene is shown in SEQ ID NO: 158. Moreover, the nucleotide sequence of the yjjP gene in *Enterobacter aerogenes* is shown in SEQ ID NO: 159 and the amino acid sequence of the protein encoded by the same gene is shown in SEQ ID NO: 160.

<The yjjB Gene>

The yjjB gene is a gene encoding a protein presumed to be a conserved inner membrane protein. The yjjB gene in the *Escherichia coli* strain MG1655 is also referred to as b3463 or ECK4353. The nucleotide sequence of the yjjB gene in the *Escherichia coli* strain MG1655 is shown in SEQ ID NO: 161 and the amino acid sequence of the protein (GenBank Accession No NP_418783.2) encoded by the same gene is shown in SEQ ID NO: 162. Moreover, the nucleotide sequence of the yjjB gene in *Enterobacter aerogenes* is shown in SEQ ID NO: 163 and the amino acid sequence of the protein encoded by the same gene is shown in SEQ ID NO: 164.

<The yeeA Gene>

The yeeA gene is a gene encoding a protein presumed to be a conserved inner membrane protein. The yeeA gene in the *Escherichia coli* strain MG1655 is also referred to as b2008 or ECK2002. The nucleotide sequence of the yeeA gene in the *Escherichia coli* strain MG1655 is shown in SEQ ID NO: 165 and the amino acid sequence of the protein (GenBank Accession No NP_416512.1) encoded by the same gene is shown in SEQ ID NO: 166. Moreover, the nucleotide sequence of the yeeA gene in the *Pantoea ananatis* strain AJ13355 is shown in SEQ ID NO: 167 and the amino acid sequence of the protein encoded by the same gene is shown in SEQ ID NO: 168. Moreover, the nucleotide sequence of the yeeA gene in *Enterobacter aerogenes* is shown in SEQ ID NO: 169 and the amino acid sequence of the protein encoded by the same gene is shown in SEQ ID NO: 170.

<The ynfM Gene>

The ynfM gene is a gene encoding a protein presumed to be a predicted transport protein YnfM. The ynfM gene in the *Escherichia coli* strain MG1655 is also referred to as b1596 or ECK1591. The nucleotide sequence of the ynfM gene in the *Escherichia coli* strain MG1655 is shown in SEQ ID NO: 171 and the amino acid sequence of the protein (GenBank Accession No NP_416113.1) encoded by the same gene is shown in SEQ ID NO: 172. Moreover, the nucleotide sequence of the ynfM gene in the *Pantoea ananatis* strain AJ13355 is shown in SEQ ID NO: 173 and the amino acid sequence of the protein encoded by the same gene is shown in SEQ ID NO: 174. Moreover, the nucleotide sequence of the ynfM gene in *Enterobacter aerogenes* is shown in SEQ ID NO: 175 and the amino acid sequence of the protein encoded by the same gene is shown in SEQ ID NO: 176. Moreover, the nucleotide sequence of the ynfM gene in *Corynebacterium glutamicum* ATCC13032 is shown in SEQ ID NO: 177 and the amino acid sequence of the protein (GenBank Accession No NP_602116.1) encoded by the same gene is shown in SEQ ID NO: 178. Moreover, the nucleotide sequence of the ynfM gene in *Corynebacterium glutamicum* ATCC 13869 is shown in SEQ ID NO: 179 and the amino acid sequence of the protein encoded by the same gene is shown in SEQ ID NO: 180.

<The sucE1 Gene>

The sucE1 gene is a gene encoding a protein presumed to be a succinate exporter. The sucE1 gene in *Corynebacterium* glutamicum ATCC13032 is also referred to as NCgl2130. The nucleotide sequence of the sucE1 gene in *Corynebacterium glutamicum* ATCC13032 is shown in SEQ ID NO: 277 and the amino acid sequence of the protein (GenBank Accession No NP_601414.1) encoded by the same gene is shown in SEQ ID NO: 278. Moreover, the nucleotide sequence of the sucE1 gene in *Corynebacterium glutamicum* ATCC13869 is shown in SEQ ID NO: 279 and the amino acid sequence of the protein encoded by the same gene is shown in SEQ ID NO: 280.

Moreover, the activity of a dicarboxylic acid exporter protein newly identified by screening may be reduced. The screening for a dicarboxylic acid exporter protein can be performed by, for example, a method as described below. The *P. ananatis* strain SC17(0) ΔsdhA/RSFPP can be used as a host for the screening. This strain is a strain in which a succinate dehydrogenase is deficient and, furthermore, the expression of the ppc and prpC genes is increased by introducing the RSFPP plasmid. The RSFPP plasmid is obtained by deleting a region including the gdhA gene from the RSFPPG plasmid (WO2010/027022A1) (see EXAMPLES below). This strain produces succinic acid under aerobic conditions, and the growth of this strain is inhibited when succinic acid is present in a medium at a low pH. Utilizing this character enables the screening of dicarboxylic acid exporter proteins, in which a minimal media at pH 4.7 containing 1 to 20 mM succinic acid is used as a medium for the screening and genomic libraries of *E. coli, P. anantis, E. aerogenes*, and the like are introduced to this strain to obtain resistant strains. Moreover, the *P. ananatis* strain SC17(0)ΔsdhAΔyeeA/RSFPP, the *P. ananatis* strain SC17(0)ΔsdhAΔynfM/RSFPP, or the *P. ananatis* strain SC17(0)ΔsdhAΔyeeAΔynfM/RSFPP, all of which are deficient in yeeA and/or ynJM, can also be used as a host for the screening.

In the present invention, the activity of one type of dicarboxylic acid exporter protein may be reduced, or the activities of two or more types of dicarboxylic acid exporter proteins may be reduced.

The reduction in the dicarboxylic acid exporter protein activity can be confirmed by, for example, identifying a reduced ability to produce succinic acid. Specifically, for example, whether a certain modified gene encodes a dicarboxylic acid exporter protein having a lower activity than that of the wild-type (non-modified) dicarboxylic acid exporter protein can be confirmed by introducing the modified gene into a strain having a significantly reduced ability to export succinic acid and identifying a reduced ability to produce succinic acid in the strain as compared with a strain in which the non-modified gene has been introduced. Examples of a strain having a significantly reduced ability to export succinic acid include, for example, *P. ananatis* SC17 (0)ΔsdhAΔyeeAΔynfM/RSFPP and *C. glutamicum* ΔldhΔsucE1 (Fukui et al., J. Biotechnol, 154(2011)25-34). Moreover, the reduction in the dicarboxylic acid exporter protein activity can also be confirmed by, for example, identifying a decreased amount of the corresponding mRNA or the corresponding protein.

The dicarboxylic acid exporter protein may be a variant of any of the aforementioned dicarboxylic acid exporter proteins such as proteins encoded by the various yjjP, yjjB, yeeA, ynJM, and sucE1 genes, so long as it has the activity to export a dicarboxylic acid. Such a variant may also be referred to as "conservative variant". Examples of the conservative variant include, for example, homologues and artificially modified variants of the aforementioned dicarboxylic acid exporter proteins such as proteins encoded by the various yjjP, yjjB, yeeA, ynJM, and sucE1 genes.

A gene coding for a homologue of the aforementioned dicarboxylic acid exporter protein can easily be obtained from a public database by, for example, BLAST search or FASTA search using the nucleotide sequence of the aforementioned gene coding for the dicarboxylic acid exporter protein as a query sequence. Furthermore, a gene coding for a homologue of the aforementioned dicarboxylic acid exporter protein can be obtained by, for example, PCR using the chromosome of a bacterium or yeast as the template, and oligonucleotides prepared on the basis of a known gene sequence thereof as primers.

The gene coding for a conservative variant of the dicarboxylic acid exporter protein may be, for example, such a gene as mentioned below. That is, the gene coding for the dicarboxylic acid exporter protein may be a gene coding for a protein having the aforementioned amino acid sequence but including substitution, deletion, insertion, or addition of one or several amino acid residues at one or several positions, so long as it codes for a protein having the activity to export a dicarboxylic acid. In such a case, usually 70% or more, 80% or more, or 90% or more, of the corresponding activity is maintained in the variant protein, relative to the protein before including addition, deletion, insertion, or addition of one or several amino acid residues. Although the number of "one or several" may differ depending on the positions in the three-dimensional structure of the protein or the types of amino acid residues, specifically, it is 1 to 50, 1 to 40, 1 to 30, 1 to 20, 1 to 10, or 1 to 5.

The aforementioned substitution, deletion, insertion, or addition of one or several amino acid residues is a conservative mutation that maintains normal function of the protein. Typical examples of the conservative mutation are conservative substitutions. The conservative substitution is a mutation wherein substitution takes place mutually among Phe, Trp, and Tyr, if the substitution site is an aromatic amino acid; among Leu, Ile, and Val, if it is a hydrophobic amino acid; between Gln and Asn, if it is a polar amino acid; among Lys, Arg, and His, if it is a basic amino acid; between Asp and Glu, if it is an acidic amino acid; and between Ser and Thr, if it is an amino acid having a hydroxyl group. Examples of substitutions considered as conservative substitutions include, specifically, substitution of Ser or Thr for Ala, substitution of Gln, His, or Lys for Arg, substitution of Glu, Gln, Lys, His, or Asp for Asn, substitution of Asn, Glu, or Gln for Asp, substitution of Ser or Ala for Cys, substitution of Asn, Glu, Lys, His, Asp, or Arg for Gln, substitution of Gly, Asn, Gln, Lys, or Asp for Glu, substitution of Pro for Gly, substitution of Asn, Lys, Gln, Arg, or Tyr for His, substitution of Leu, Met, Val, or Phe for Ile, substitution of Ile, Met, Val, or Phe for Leu, substitution of Asn, Glu, Gln, His, or Arg for Lys, substitution of Ile, Leu, Val, or Phe for Met, substitution of Trp, Tyr, Met, Ile, or Leu for Phe, substitution of Thr or Ala for Ser, substitution of Ser or Ala for Thr, substitution of Phe or Tyr for Trp, substitution of His, Phe, or Trp for Tyr, and substitution of Met, Ile, or Leu for Val. Furthermore, such substitution, deletion, insertion, addition, inversion, or the like of amino acid residues as mentioned above includes a naturally occurring mutation due to an individual difference, or a difference of species of the organism from which the gene is derived (mutant or variant).

Furthermore, the gene having such a conservative mutation as mentioned above may be a gene coding for a protein showing a homology of 80% or more, 90% or more, 95% or more, 97% or more, or 99% or more, to the total amino acid sequence mentioned above, and having the activity to export a dicarboxylic acid. In addition, in this specification, "homology" means "identity".

Moreover, the gene coding for the dicarboxylic acid exporter protein may be a DNA that is able to hybridize under stringent conditions with a probe that can be prepared from a known gene sequence, such as a sequence complementary to a part or the whole of the aforementioned nucleotide sequence, and which DNA codes for a protein having the activity to export a dicarboxylic acid. The "stringent conditions" refer to conditions under which a so-called specific hybrid is formed, and a non-specific hybrid is not formed. Examples of the stringent conditions include those under which highly homologous DNAs hybridize to each other, for example, DNAs not less than 80% homologous, not less than 90% homologous, not less than 95% homologous, not less than 97% homologous, or not less than 99% homologous, hybridize to each other, and DNAs less homologous than the above do not hybridize to each other, or conditions of washing of typical Southern hybridization, i.e., conditions of washing once, preferably 2 or 3 times, at a salt concentration and temperature corresponding to 1×SSC, 0.1% SDS at 60° C., 0.1×SSC, 0.1% SDS at 60° C., or 0.1×SSC, 0.1% SDS at 68° C.

The probe used for the aforementioned hybridization may be a part of a sequence that is complementary to the gene as described above. Such a probe can be prepared by PCR using oligonucleotides prepared on the basis of a known gene sequence as primers and a DNA fragment containing the nucleotide sequence as a template. As the probe, for example, a DNA fragment having a length of about 300 bp can be used. When a DNA fragment having a length of about 300 bp is used as the probe, the washing conditions of the hybridization may be, for example, 50° C., 2×SSC and 0.1% SDS.

Furthermore, the gene coding for the dicarboxylic acid exporter protein may be a gene in which an arbitrary codon is replaced with an equivalent codon, so long as the gene codes for a protein having the activity to export a dicarboxylic acid. For example, the gene coding for the dicarboxylic acid exporter protein may be modified so that it has optimal codons according to codon frequencies in a host to be used.

The percentage of the sequence identity between two sequences can be determined by, for example, using a mathematical algorithm. Non-limiting examples of such a mathematical algorithm include the algorithm of Myers and Miller (1988) CABIOS 4:11-17, the local homology algorithm of Smith et al (1981) Adv. Appl. Math. 2:482, the homology alignment algorithm of Needleman and Wunsch (1970) J. Mol. Biol. 48:443-453, the method for searching homology of Pearson and Lipman (1988) Proc. Natl. Acad. Sci. 85:2444-2448, and an modified version of the algorithm of Karlin and Altschul (1990) Proc. Natl. Acad. Sci. USA 87:2264, such as that described in Karlin and Altschul (1993) Proc. Natl. Acad. Sci. USA 90:5873-5877.

By using a program based on such a mathematical algorithm, sequence comparison (i.e. alignment) for determining the sequence identity can be performed. The program can be appropriately executed by a computer. Examples of such a program include, but are not limited to, CLUSTAL of PC/Gene program (available from Intelligenetics, Mountain View, Calif.), ALIGN program (Version 2.0), and GAP, BESTFIT, BLAST, FASTA, and TFASTA of Wisconsin Genetics Software Package, Version 8 (available from Genetics Computer Group (GCG), 575 Science Drive, Madison, Wis., USA). Alignment using these programs can be performed by using, for example, initial parameters. The CLUSTAL program is well described in Higgins et al. (1988) Gene 73:237-244 (1988), Higgins et al. (1989) CABIOS 5:151-153, Corpet et al. (1988) Nucleic Acids Res. 16:10881-90, Huang et al. (1992) CABIOS 8:155-65, and Pearson et al. (1994) Meth. Mol. Biol. 24:307-331.

In order to obtain a nucleotide sequence homologous to a target nucleotide sequence, in particular, for example, BLAST nucleotide search can be performed by using BLASTN program with score of 100 and word length of 12. In order to obtain an amino acid sequence homologous to a target protein, in particular, for example, BLAST protein search can be performed by using BLASTX program with score of 50 and word length of 3. See http://www.ncbi.nlm.nih.gov for BLAST nucleotide search and BLAST protein search. In addition, Gapped BLAST (BLAST 2.0) can be used in order to obtain an alignment including gap(s) for the purpose of comparison. In addition, PSI-BLAST can be used in order to perform repetitive search for detecting distant relationships between sequences. See Altschul et al. (1997) Nucleic Acids Res. 25:3389 for Gapped BLAST and PSI-BLAST. When using BLAST, Gapped BLAST, or PSI-BLAST, initial parameters of each program (e.g. BLASTN for nucleotide sequences, and BLASTX for amino acid sequences) can be used. An alignment can also be manually performed.

The sequence identity between two sequences is calculated as the ratio of residues matching in the two sequences when aligning the two sequences so as to fit maximally with each other.

The above descriptions concerning conservative variants of genes and proteins can also be applied mutatis mutandis to other proteins such as α-ketoglutarate synthase and genes coding for them.

<1-3> Additional Modifications

The microorganism of the present invention may further have other modification(s). The other modification(s) can be appropriately selected depending on the type of the objective substance, the type of the microorganism, and the like.

For example, the microorganism of the present invention may have been modified to have an attenuated reaction for oxidizing NADH. For example, the microorganism of the present invention may have been modified to have an attenuated reaction related to energy metabolism and/or an attenuated biosynthetic system for pyruvic acid or acetyl-CoA-derived substances, the reaction and system involving the oxidation of NADH, so that the reaction of oxidizing NADH is attenuated.

Attenuation of a reaction related to energy metabolism, the reaction involving the oxidation of NADH, can be achieved by reducing the activity of one or more types of enzymes involved in the same reaction. The enzymes involved in the reaction may each be an enzyme directly oxidizing NADH or an enzyme indirectly oxidizing NADH through coupling with other enzyme(s) and the like. Examples of enzymes involved in the same reaction include, for example, NADH dehydrogenase and malate:quinone oxidoreductase (MQO). NADH dehydrogenase is an enzyme which directly oxidizes NADH. MQO is an enzyme which indirectly oxidizes NADH. For example, the activity of either NADH dehydrogenase or MQO may be reduced, or the activities of both enzymes may be reduced.

Attenuation of a biosynthetic system for pyruvic acid or acetyl-CoA-derived substances, the system involving the oxidation of NADH, can be achieved by reducing the activity of one or more types of enzymes in the same biosynthetic system. Examples of enzymes in the same biosynthetic system include, for example, enzymes as indicated below (WO2009/072562):

lactate dehydrogenase (lactate biosynthetic system);
alcohol dehydrogenase (ethanol biosynthetic system);
acetolactate synthase, acetolactate decarboxylase, and acetoin reductase (2,3-butanediol biosynthetic system).

That is, specifically, the microorganism of the present invention may have been modified, for example, to have (a) a reduced activity of one or more types of enzymes such as NADH dehydrogenase and malate:quinone oxidoreductase, and/or (b) a reduced activity of one or more types of enzymes such as lactate dehydrogenase, alcohol dehydrogenase, acetolactate synthase, acetolactate decarboxylase, and acetoin reductase. The activity of an enzyme can be reduced by disrupting a gene encoding the enzyme, and the like. Detailed procedures to reduce the activity of the enzyme will be described below.

The term "NADH dehydrogenase" refers to a protein having an activity to catalyze a reaction for oxidizing NADH by using a quinone as an electron acceptor. Moreover, this activity is also referred to as "NADH dehydrogenase activity". NADH dehydrogenases are classified into type I and type II. The activity of either type I or type II may be reduced, or the activities of both types may be reduced.

Type I NADH dehydrogenase is a NADH dehydrogenase which has a proton-exporting ability and is also referred to as NDH-1 or NADH:ubiquinone reductase. A type I NADH dehydrogenase specifically catalyzes the reaction below:

$$NADH+quinone+5H^+_{in} \rightarrow NAD^++quinol+4H^+_{out} \quad (EC\ 1.6.5.3).$$

Examples of genes encoding NDH-1 include, the nuoABCEFGHIJKLMN operon (also referred to as "the nuo operon"). The nuo operon encodes subunits below and these subunits form a complex that functions as NDH-1:

Membrane subunit A, H, J, K, L, M, N
membrane subunit A=NuoA (nuoA),
membrane subunit H=NuoH (nuoH),
membrane subunit J=NuoJ (nuoJ),
membrane subunit K=NuoK (nuoK),
membrane subunit L=NuoL (nuoL),
membrane subunit M=NuoM (nuoM),
membrane subunit N=NuoN (nuoN);
soluble NADH dehydrogenase fragment, chain E, F, G
NADH: ubiquinone oxidoreductase, chain E=NuoE (nuoE),
NADH: ubiquinone oxidoreductase, chain F=NuoF (nuoF),
NADH:ubiquinone oxidoreductase, chain G=NuoG (nuoG);
connecting fragment of NADH dehydrogenase I, chain B, CD, I
NADH:ubiquinone oxidoreductase, chain B=NuoB (nuoB),
NADH:ubiquinone oxidoreductase, chain CD=NuoC (nuoC),
NADH: ubiquinone oxidoreductase, chain I=NuoI (nuoI).

The nuoABCEFGHIJKLMN operon in *E. coli* MG1655 corresponds to a sequence complementary to a sequence from position 2388070 to 2403094 of a genomic sequence registered as GenBank accession NC_000913 (VERSION NC_000913.2 GI:49175990) in the NCBI database. The nucleotide sequence of the nuoABCEFGHIJKLMN operon in *E. coli* MG1655 is shown in SEQ ID NO: 1. Moreover, the position of the coding region of each gene (excluding its termination codon) in SEQ ID NO: 1 and the sequence identification number for the amino acid sequence of a subunit encoded by each gene are as shown below:

nuoA; 1-441 (NuoA; SEQ ID NO: 2),
nuoB; 460-1119 (NuoB; SEQ ID NO: 3),
nuoC; 1228-3015 (NuoC; SEQ ID NO: 4),
nuoE; 3021-3518 (NuoE; SEQ ID NO: 5),
nuoF; 3518-4852 (NuoF; SEQ ID NO: 6),
nuoG; 4908-7631 (NuoG; SEQ ID NO: 7),
nuoH; 7631-8605 (NuoH; SEQ ID NO: 8),
nuoI; 8623-9162 (NuoI; SEQ ID NO: 9),
nuoJ; 9177-9728 (NuoJ; SEQ ID NO: 10),
nuoK; 9728-10027 (NuoK; SEQ ID NO: 11),
nuoL; 10027-11865 (NuoL; SEQ ID NO: 12),
nuoM; 12032-13558 (NuoM; SEQ ID NO: 13),
nuoN; 13568-15022 (NuoN; SEQ ID NO: 14).

The nuoABCEFGHIJKLMN operon in *Pantoea ananatis* LMG20103 corresponds to a sequence complementary to a sequence from position 2956133 to 2971292 of a genomic sequence registered as GenBank accession NC_013956 (VERSION NC_013956.2 GI:332139403) in the NCBI database. Moreover, the nuoABCEFGHIJKLMN operon in *Pantoea ananatis* AJ13355 corresponds to a sequence complementary to a sequence from position 2333027 to 2348186 of a genomic sequence registered as GenBank accession NC_017531 (VERSION NC_017531.1 GI:386014600) in the NCBI database. The nucleotide sequence of the nuoABCEFGHIJKLMN operon in *Pantoea ananatis* AJ13355 is shown in SEQ ID NO: 15. Moreover, the position of the coding region of each nuo gene (excluding its termination codon) in SEQ ID NO: 15 and the sequence identification number for the amino acid sequence of a subunit encoded by each nuo gene are as shown below:

nuoA; 1-441 (NuoA; SEQ ID NO: 16),
nuoB; 460-1134 (NuoB; SEQ ID NO: 17),
nuoC; 1255-3051 (NuoC; SEQ ID NO: 18),
nuoE; 3057-3569 (NuoE; SEQ ID NO: 19),
nuoF; 3569-4912 (NuoF; SEQ ID NO: 20),
nuoG; 5027-7747 (NuoG; SEQ ID NO: 21),
nuoH; 7747-8721 (NuoH; SEQ ID NO: 22),
nuoI; 8736-9275 (NuoI; SEQ ID NO: 23),
nuoJ; 9238-9837 (NuoJ; SEQ ID NO: 24),
nuoK; 9837-10136 (NuoK; SEQ ID NO: 25),
nuoL; 10136-11968 (NuoL; SEQ ID NO: 26),
nuoM; 12281-13693 (NuoM; SEQ ID NO: 27),
nuoN; 13703-15157 (NuoN; SEQ ID NO: 28).

Incidentally, coryneform bacteria have no NDH-1.

The activity of NDH-1 can be reduced by modifying one or more genes selected from the nuo operon. Moreover, the activity of NDH-1 can also be reduced through a reduction of all transcription from the nuo operon by modifying a region that affects the transcription of the nuo operon (e.g. promoter element and/or SD sequence).

Type II NADH dehydrogenase is a NADH dehydrogenase which does not have a proton-exporting ability and is also referred to as NDH-2, NADH dhII, or NADH dehydrogenase II. A type II NADH dehydrogenase specifically catalyzes the reaction below:

$$NADH+H^++quinone \rightarrow NAD^++quinol \quad (EC\ 1.6.99.3\ or\ EC\ 1.6.99.5).$$

Examples of a gene encoding NDH-2 include the ndh gene.

The ndh gene in *E. coli* MG1655 corresponds to a sequence from position 1165308 to 1166612 of a genomic sequence registered as GenBank accession NC_000913 (VERSION NC_000913.2 GI:49175990) in the NCBI database. The ndh gene in *E. coli* MG1655 is synonymous with ECK1095 and JW1095. Moreover, the Ndh protein in *E. coli* MG1655 is registered as GenBank accession NP_415627 (version NP_415627.1 GI:16129072, locus_tag="b1109").

The nucleotide sequence of the ndh gene in E. coli MG1655 and the amino acid sequence of the Ndh protein encoded by the same gene are shown in SEQ ID NOs: 29 and 30, respectively.

The ndh gene in Pantoea ananatis LMG20103 corresponds to a sequence from position 1685397 to 1686704 of a genomic sequence registered as GenBank accession NC_013956 (VERSION NC_013956.2 GI:332139403) in the NCBI database. Moreover, the Ndh protein in Pantoea ananatis LMG20103 is registered as GenBank accession YP_003519794 (version YP_003519794.1 GI:291617052, locus_tag="PANA_1499"). Moreover, the ndh gene in Pantoea ananatis AJ13355 corresponds to a sequence from position 1000123 to 1001370 of a genomic sequence registered as GenBank accession NC_017531 (VERSION NC_017531.1 GI:386014600) in the NCBI database. Moreover, the Ndh protein in Pantoea ananatis AJ13355 is registered as GenBank accession YP_005933721 (version YP_005933721.1 GI:386015440). The nucleotide sequence of the ndh gene in Pantoea ananatis AJ13355 and the amino acid sequence of the Ndh protein encoded by the same gene are shown in SEQ ID NOs: 31 and 32, respectively.

The ndh gene in Corynebacterium glutamicum ATCC13032 corresponds to a sequence complementary to a sequence from position 1543151 to 1544554 of a genomic sequence registered as GenBank accession NC_003450 (VERSION NC_003450.3 GI:58036263) in the NCBI database. The ndh gene in Corynebacterium glutamicum ATCC13032 is synonymous with Cgl1465. Moreover, the Ndh protein in Corynebacterium glutamicum ATCC13032 is registered as GenBank accession NP_600682 (version NP_600682.1 GI:19552680, locus_tag="NCgl1409"). The nucleotide sequence of the ndh gene in Corynebacterium glutamicum ATCC13032 and the amino acid sequence of the Ndh protein encoded by the same gene are shown in SEQ ID NOs: 85 and 86, respectively.

The reduction in the NADH dehydrogenase activity can be confirmed, for example, by measuring the NADH dehydrogenase activity. The activity of either type I NADH dehydrogenase or type II NADH dehydrogenase can be measured by a known method (Journal of Biotechnology 158 (2012) p 215-223). In the same method, the reduction in NADH concentration is determined using a solution of a solubilized membrane fraction by measuring the absorbance at 340 nm to calculate the total activity of the NADH dehydrogenase (the sum of the type I NADH dehydrogenase activity and the type II NADH dehydrogenase activity), and the type II NADH dehydrogenase activity can be calculated indirectly by subtracting the value of the type I NADH dehydrogenase activity from the value of the total activity.

The term "malate:quinone oxidoreductase" refers to a protein having an activity to catalyze a reaction for oxidizing malic acid by using a quinone as an electron acceptor. Moreover, this activity is also referred to as "malate:quinone oxidoreductase activity". A malate: quinone oxidoreductase specifically catalyzes the reaction below:

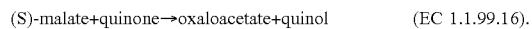

(S)-malate+quinone→oxaloacetate+quinol     (EC 1.1.99.16).

The malate:quinone oxidoreductase is coupled with the NAD-malate dehydrogenase to form a cycle between malate and oxaloacetate and thereby provides net oxidation of NADH.

Examples of a gene encoding a malate:quinone oxidoreductase include the mqo gene.

The mqo gene in E. coli MG1655 corresponds to a sequence complementary to a sequence from position 2303130 to 2304776 of a genomic sequence registered as GenBank accession NC_000913 (VERSION NC_000913.2 GI:49175990) in the NCBI database. The mqo gene in E. coli MG1655 is synonymous with ECK2202, JW2198, and yojH. Moreover, the Mqo protein in E. coli MG1655 is registered as GenBank accession NP_416714 (version NP_416714.1 GI:16130147, locus_tag="b2210"). The nucleotide sequence of the mqo gene in E. coli MG1655 and the amino acid sequence of the Mqo protein encoded by the same gene are shown in SEQ ID NOs: 33 and 34, respectively.

Moreover, for example, some Pantoea bacteria have two copies of malate: quinone oxidoreductase genes (hereinafter also referred to as "the mqo1 gene" and "the mqo2 gene"). The mqo1 and mqo2 genes in Pantoea ananatis LMG20103 correspond to a sequence from position 4213429 to 4215042 and a sequence complementary to a sequence from position 4560249 to 4561898 of a genomic sequence registered as GenBank accession NC_013956 (VERSION NC_013956.2 GI:332139403) in the NCBI database, respectively. Moreover, the proteins encoded by the mqo1 and mqo2 genes in Pantoea ananatis LMG20103 are registered as GenBank accession YP_003522102 (version YP_003522102.1 GI:291619360, locus_tag="PANA_3807") and GenBank accession YP_003522407 (version YP_003522407.1 GI:291619665, locus_tag="PANA_4112"), respectively. Moreover, the mqo1 and mqo2 genes in Pantoea ananatis AJ13355 correspond to a sequence from position 197167 to 198816 and a sequence from position 3620570 to 3622183 of a genomic sequence registered as GenBank accession NC_017531 (VERSION NC_017531.1 GI:386014600) in the NCBI database, respectively. Moreover, the proteins encoded by the mqo1 and mqo2 genes in Pantoea ananatis AJ13355 are registered as GenBank accession YP_005941143 (version YP_005941143.1 GI:386018537) and GenBank accession YP_005935901 (version YP_005935901.1 GI:386017603), respectively. The nucleotide sequence of the mqo1 gene in Pantoea ananatis AJ13355 and the amino acid sequence of the protein encoded by the same gene are shown in SEQ ID NOs: 35 and 36, respectively. The nucleotide sequence of the mqo2 gene in Pantoea ananatis AJ13355 and the amino acid sequence of the protein encoded by the same gene are shown in SEQ ID NOs: 97 and 98, respectively.

The mqo gene in Corynebacterium glutamicum ATCC13032 corresponds to a sequence complementary to a sequence from position 2113861 to 2115363 of a genomic sequence registered as GenBank accession NC_003450 (VERSION NC_003450.3 GI:58036263) in the NCBI database. The mqo gene in Corynebacterium glutamicum ATCC13032 is synonymous with Cgl2001. Moreover, the Mqo protein in Corynebacterium glutamicum ATCC13032 is registered as GenBank accession NP_601207 (version NP_601207.1 GI:19553205, locus_tag="NCgl1926"). The nucleotide sequence of the mqo gene in Corynebacterium glutamicum ATCC13032 and the amino acid sequence of the Mqo protein encoded by the same gene are shown in SEQ ID NOs: 87 and 88, respectively.

The malate:quinone oxidoreductase activity can be measured by a known method (Eur. J. Biochem. 254 (1998) 395-403).

The term "lactate dehydrogenase" refers to an enzyme which catalyzes a reaction for the production of lactic acid from pyruvic acid by using NADH or NADPH as an electron donor. Moreover, the activity to catalyze this reaction is also referred to as "lactate dehydrogenase activity". Lactate dehydrogenases are broadly classified into L-lactate dehydrogenase (L-LDH; EC 1.1.1.27), which produces L-lactic acid, and D-lactate dehydrogenase (D-LDH; EC1.1.1.28), which produces D-lactic acid, and either activity may be reduced. The lactate dehydrogenase (LDH) activity can be reduced, for example, by disrupting a gene encoding a lactate dehydrogenase (LDH gene), as described below, and the like. The nucleotide sequence of the D-LDH gene (ldhA) in *Escherichia coli* is shown in SEQ ID NO: 37 and the amino acid sequence encoded by the same gene is shown in SEQ ID NO: 38. The nucleotide sequence of the D-LDH gene (ldhA) in *Pantoea ananatis* is shown in SEQ ID NO: 39 and the amino acid sequence encoded by the same gene is shown in SEQ ID NO: 40. The nucleotide sequence of the L-LDH gene (ldh) in *Corynebacterium glutamicum* ATCC13032 is shown in SEQ ID NO: 229 and the amino acid sequence encoded by the same gene is shown in SEQ ID NO: 230. The nucleotide sequence of the L-LDH gene (ldh) in the *Corynebacterium glutamicum* strain 2256 (ATCC 13869) is shown in SEQ ID NO: 231 and the amino acid sequence encoded by the same gene is shown in SEQ ID NO: 232. The reduction in the lactate dehydrogenase activity can be confirmed, for example, by measuring the lactate dehydrogenase activity with a known method (L. Kanarek and R. L. Hill, J. Biol. Chem. 239, 4202 (1964)). Examples of a specific method to construct a mutant strain of enteric bacteria having a reduced lactate dehydrogenase activity include a method described in Alam, K. Y, Clark, D. P. 1989. J. Bacteriol. 171: 6213-6217, and the like.

The term "alcohol dehydrogenase" refers to an enzyme which catalyzes a reaction for the production of alcohol from aldehydes by using NADH or NADPH as an electron donor (EC 1.1.1.1, EC 1.1.1.2, or EC 1.1.1.71). Moreover, the activity to catalyze the same reaction is also referred to as "alcohol dehydrogenase activity". The alcohol dehydrogenase (ADH) activity can be reduced, for example, by disrupting a gene encoding an alcohol dehydrogenase (ADH gene), as described below, and the like. The nucleotide sequence of the adhE gene as an ADH gene in *Escherichia coli* is shown in SEQ ID NO: 41 and the amino acid sequence encoded by the same gene is shown in SEQ ID NO: 42. The nucleotide sequence of the adhE gene as an ADH gene in *Pantoea ananatis* is shown in SEQ ID NO: 43 and the amino acid sequence encoded by the same gene is shown in SEQ ID NO: 44. The nucleotide sequence of the adhE gene in *Corynebacterium glutamicum* ATCC13032 as an ADH gene in *Corynebacterium glutamicum* is shown in SEQ ID NO: 233 and the amino acid sequence encoded by the same gene is shown in SEQ ID NO: 234. The reduction in the alcohol dehydrogenase activity can be confirmed, for example, by measuring the alcohol dehydrogenase activity with a known method (Lutstorf, U. M., Schurch, P. M. & von Wartburg, J. P., Eur. J. Biochem. 17, 497-508 (1970)). Examples of a specific method to construct a mutant strain of enteric bacteria having a reduced alcohol dehydrogenase activity include a method described in Sanchez, A. M., Bennett, G. N., San, K.-Y, Biotechnol. Prog. 21, 358-365 (2005), and the like.

The term "acetolactate synthase" refers to an enzyme which catalyzes a reaction for the production of an acetolactic acid molecule and $CO_2$ from two pyruvic acid molecules (EC 2.2.1.6). Moreover, the activity to catalyze the same reaction is also referred to as "acetolactate synthase activity". In the acetolactate synthase (AHAS), AHAS isozymes I to III are known and the activity of any of the isozymes may be reduced. The acetolactate synthase activity can be reduced, for example, by disrupting a gene encoding an acetolactate synthase, as described below, and the like. Examples of a gene encoding an acetolactate synthase include the ilvB gene, the ilvG gene, and the ilvI gene, which encode catalytic subunits of the AHAS I, AHAS II, and AHAS III, respectively. The nucleotide sequences of the ilvB and ilvI genes in *E. coli* MG1655 are shown in SEQ ID NOs: 235 and 237, respectively; and the amino acid sequences of the proteins encoded by the same genes are shown in SEQ ID NOs: 236 and 238, respectively. The nucleotide sequences of the ilvG and ilvI genes in *Pantoea ananatis* AJ13355 are shown in SEQ ID NOs: 239 and 241, respectively; and the amino acid sequences of the proteins encoded by the same genes are shown in SEQ ID NOs: 240 and 242, respectively. The nucleotide sequence of the ilvB gene in *Corynebacterium glutamicum* ATCC 13032 is shown in SEQ ID NO: 243 and the amino acid sequence of the protein encoded by the same gene is shown in SEQ ID NO: 244. The reduction in the acetolactate synthase activity can be confirmed, for example, by measuring the acetolactate synthase activity with a known method (F. C. Stormer and H. E. Umbarger, Biochem. Biophys. Res. *Commun.*, 17, 5, 587-592 (1964)).

The term "acetolactate decarboxylase" refers to an enzyme which catalyzes a reaction for the production of acetoin by decarboxylation of acetolactate (EC 4.1.1.5). Moreover, the activity to catalyze the same reaction is also referred to as "the acetolactate decarboxylase activity". The acetolactate decarboxylase activity can be reduced, for example, by disrupting a gene encoding an acetolactate decarboxylase, as described below, and the like. The nucleotide sequence of the acetolactate decarboxylase gene (budA) in *Pantoea ananatis* AJ13355 is shown in SEQ ID NO: 245 and the amino acid sequence of the protein encoded by the same gene is shown in SEQ ID NO: 246. Incidentally, *E. coli* and *Corynebacterium glutamicum* have no acetolactate decarboxylase. The reduction in the acetolactate decarboxylase activity can be confirmed, for example, by measuring the acetolactate decarboxylase activity with a known method (Juni E., J. Biol. Chem., 195(2): 715-726 (1952)).

The term "acetoin reductase" refers to an enzyme which catalyzes a reaction for the production of 2,3-butanediol from acetoin by using NADH or NADPH as an electron donor (EC 1.1.1.4). Moreover, the activity to catalyze the same reaction is also referred to as "acetoin reductase activity". The acetoin reductase activity can be reduced, for example, by disrupting a gene encoding an acetoin reductase, as described below, and the like. The nucleotide sequence of the acetoin reductase gene (budC) in *Pantoea ananatis* AJ13355 is shown in SEQ ID NO: 247 and the amino acid sequence of the protein encoded by the same gene is shown in SEQ ID NO: 248. The nucleotide sequence of the acetoin reductase gene (butA) in *Corynebacterium glutamicum* ATCC 13032 is shown in SEQ ID NO: 249 and the amino acid sequence of the protein encoded by the same gene is shown in SEQ ID NO: 250. Incidentally, for example, *E. coli* has no acetoin reductase. The reduction in the acetoin reductase activity can be confirmed, for example, by measuring the acetoin reductase activity with a known method (K. Blomqvist et al., J Bacteriol., 175, 5, 1392-1404 (1993)).

Moreover, the microorganism of the present invention may have been modified to have an attenuated acetate biosynthetic system. Specifically, the microorganism of the present invention may have been modified, for example, to have a reduced activity of one or more enzymes selected from the enzymes below (US2007-0054387, WO2005/052135, WO99/53035, WO2006/031424, WO2005/113745, and WO2005/113744):

phosphotransacetylase;
acetate kinase;
pyruvate oxidase;
acetyl-CoA hydrolase.

The phosphotransacetylase (PTA) activity can be reduced, for example, by disrupting a gene encoding a phosphotransacetylase (PTA gene), as described below, and the like. The nucleotide sequence of the pta gene in *Escherichia coli* is shown in SEQ ID NO: 45 and the amino acid sequence encoded by the same gene is shown in SEQ ID NO: 46. The nucleotide sequence of the pta gene in *Pantoea ananatis* is shown in SEQ ID NO: 47 and the amino acid sequence encoded by the same gene is shown in SEQ ID NO: 48. The reduction in the phosphotransacetylase activity can be confirmed by measuring the phosphotransacetylase activity with a known method (Klotzsch, H. R., Meth. Enzymol. 12, 381-386 (1969)).

Moreover, the microorganism of the present invention may have been modified to have a reduced pyruvate formate lyase (PFL) activity. The pyruvate formate lyase activity can be reduced, for example, by disrupting a gene encoding a pyruvate formate lyase (PFL gene), as described below, and the like. The nucleotide sequences of the pflB, pflD, and tdcE genes as PFL genes in *Escherichia coli* are shown in SEQ ID NOs: 89, 91, and 93, respectively; and the amino acid sequences of the proteins encoded by the same genes are shown in SEQ ID NOs: 90, 92, and 94, respectively. The nucleotide sequence of the pflB gene in *Pantoea ananatis* is shown in SEQ ID NO: 95 and the amino acid sequence of the protein encoded by the same gene is shown in SEQ ID NO: 96. The reduction in the pyruvate formate lyase activity can be confirmed by measuring the pyruvate formate lyase activity with a known method (Knappe, J. & Blaschkowski, H. P., Meth. Enzymol. 41, 508-518 (1975)).

Moreover, the microorganism of the present invention may have been modified to have a reduced succinate dehydrogenase (SDH) activity. The succinate dehydrogenase activity can be reduced, for example, by disrupting a gene encoding a succinate dehydrogenase (SDH gene), as described below, and the like. The reduction in the succinate dehydrogenase activity can be confirmed by measuring the succinate dehydrogenase activity with a known method (Tatsuki Kurokawa and Junshi Sakamoto, Arch. Microbiol. 183: 317-324 (2005)).

Moreover, the microorganism of the present invention may have been modified to have a reduced activity of a fumarate reductase using reduced quinone as an electron donor (quinone-fumarate reductase; EC 1.3.5.1 or EC 1.3.5.4) and an increased activity of a fumarate reductase using NADH as an electron donor (NADH-fumarate reductase; EC 1.3.1.6). Specifically, for example, a gene encoding a quinone-fumarate reductase can be replaced with a gene encoding a NADH-fumarate reductase. The gene replacement can be performed, for example, by the procedures described below. Examples of a NADH-fumarate reductase include, for example, FRDS1 and FRDS2 of *Saccharomyces cerevisiae*. In *Saccharomyces cerevisiae*, FRDS1 and FRDS2 are encoded by the FRDS gene and the OSM1 gene, respectively.

Moreover, the microorganism of the present invention may have been modified to have an enhanced anaplerotic pathway for the TCA cycle. Specifically, the microorganism of the present invention may have been modified, for example, to have an increased activity of one or more enzymes selected from the enzymes below (Japanese Patent Application Publication No. Hei-11-196888, Japanese Patent Application Publication No. 2006-320208, WO99/53035, WO2005/021770; Hong S H, Lee S Y. Biotechnol Bioeng. 74(2): 89-95 (2001); Millard, C. S., Chao, Y P., Liao, J. C., Donnelly, M. I. Appl. Environ. Microbiol. 62: 1808-1810 (1996); Pil Kim, Maris Laivenieks, Claire Vieille, and J. Gregory Zeikus. Appl. Environ. Microbiol. 70: 1238-1241 (2004)):
pyruvate carboxylase;
phosphoenolpyruvate carboxylase;
phosphoenolpyruvate carboxykinase.

The activity of an enzyme can be increased, for example, by increasing the expression of a gene encoding the enzyme, as described below. Examples of a gene encoding a pyruvate carboxylase include, for example, the PC genes of coryneform bacteria such as *Corynebacterium glutamicum* and *Brevibacterium flavum*; *Bacillus stearothermophilus*; *Rhizobium etli*; and yeasts such as *Saccharomyces cerevisiae* and *Schizosaccharomyces pombe* (WO2009/072562). Examples of a gene encoding a phosphoenolpyruvate carboxykinase include, for example, the pckA gene of *Actinobacillus succinogenes* (GenBank Accession No. YP_001343536.1), the pckA gene of *Haemophilus influenzae* (GenBank Accession No. YP_248516.1), the pckA gene of *Pasteurella multocida* (GenBank Accession No. NP_246481.1), the pckA gene of *Mannheimia succiniciproducens* (GenBank Accession No. YP_089485.1), the pckA gene of *Yersinia pseudotuberculosis* (GenBank Accession No. YP_072243), the pckA gene of *Vibrio cholerae* (GenBank Accession No. ZP_01981004.1), and the pckA gene of *Selenomonas ruminantium* (GenBank Accession No. AB016600) (WO2009/072562). Examples of a gene encoding a phosphoenolpyruvate carboxylase include, for example, the ppc genes of coryneform bacteria such as *Corynebacterium glutamicum* and *Brevibacterium flavum*; *Escherichia* bacteria such as *Escherichia coli*; and *Rhodopseudomonas palustris*. Moreover, the activity of an enzyme can also be increased, for example, by reducing or removing the feedback inhibition. For example, the phosphoenolpyruvate carboxylase (PEPC) activity is inhibited by L-malic acid, which is an intermediate of the succinate biosynthesis pathway (Masato Yano and Katsura Izui, Eur. Biochem. FEBS, 247, 74-81, 1997). The inhibition by L-malic acid can be reduced, for example, by introducing a desensitization mutation into PEPC with a single amino acid substitution. Specific examples of a desensitization mutation with a single amino acid substitution include, for example, a mutation causing a substitution of the amino acid at position 620 from lysine to serine in the PEPC protein from *Escherichia coli* (supra).

Moreover, the microorganism of the present invention may have been modified to have an increased α-ketoglutarate synthase (α-KGS) activity. The term "α-ketoglutarate synthase" refers to an enzyme which catalyzes a reaction for the production of α-ketoglutaric acid (2-oxoglutaric acid) from succinyl-CoA and $CO_2$ bp using reduced ferredoxin or reduced flavodoxin as an electron donor (EC 1.2.7.3). Moreover, the activity to catalyze the same reaction is also referred to as "α-ketoglutarate synthase activity". α-Ketoglutarate synthase is also referred to as α-ketoglutarate oxidoreductase, α-ketoglutarate ferredoxin oxidoreductase, 2-oxoglutarate synthase, 2-oxoglutarate oxidoreductase, or 2-oxoglutarate ferredoxin oxidoreductase. The α-ketoglutarate synthase is known to function in a multisubunit complex, usually as a heterodimer composed of an α-subunit and a β-subunit. The α-ketoglutarate synthase activity can be increased, for example, by increasing the expression of gene(s) encoding an α-ketoglutarate synthase (α-ketoglutarate synthase gene(s)), as described below.

Examples of α-ketoglutarate synthase genes include, for example, the α-ketoglutarate synthase genes of bacteria in the genera *Chlorobium, Desulfobacter, Aquifex, Hydrogenobacter, Thermoproteus*, and *Pyrobaculum*, all of which bacteria possess the reductive TCA cycle, and specifically include the α-ketoglutarate synthase genes of *Chlorobium tepidum* and *Hydrogenobacter thermophilus*. Moreover, examples of α-ketoglutarate synthase genes include, for example, the α-ketoglutarate synthase genes of *Blastopirellula marina*, which is a marine bacterium belonging to the order Planctomycetes (Schlesner, H. et al. 2004. Int. J. Syst. Evol. Microbiol. 54: 1567-1580), *Sulfurimonas denitrificans*, which is a sulfur-oxidizing bacterium belonging to ε-Proteobacteria (Brinkhoff, T. et al. 1999. Int. J. Syst. Bacteriol. 49:875-879), and *Methanococcus maripaludis*, which is a methane-producing bacterium belonging to archaea (Jones, W. J. et al. Arch. Microbiol. 1983. 135: 91-97).

The genomic sequence of *Chlorobium tepidum* (GenBank Accession No. NC_002932) has been determined (Eisen, J. A. et al. 2002. Proc. Natl. Acad. Sci. USA 99: 9509-9514). The nucleotide sequence of the α-subunit gene of the α-ketoglutarate synthase, which is located in the region from base position 170164 to 172047 (complementary strand) in the genomic sequence of *Chlorobium tepidum*, is shown in SEQ ID NO: 49 and the nucleotide sequence of the β-subunit gene of the same, which is located in the region from base position 169132 to 170160 (complementary strand) in the genomic sequence of *Chlorobium tepidum*, is shown in SEQ ID NO: 51. Moreover, the amino acid sequence of the α-subunit of the α-ketoglutarate synthase encoded by the same gene (GenBank Accession No. NP_661069) is shown in SEQ ID NO: 50 and the amino acid sequence of the β-subunit of the same (GenBank Accession No. NP_661068) is shown in SEQ ID NO: 52. The genomic sequence of *Blastopirellula marina* (GenBank Accession No. AANZ00000000) has been determined (Fuchsman, C. A., and Rocap, G Appl. Environ. Microbiol. 2006. 72: 6841-6844). The nucleotide sequence of the α-subunit gene of the α-ketoglutarate synthase, which is located in the region from base position 3180 to 5045 (complementary strand) in the genomic sequence of *Blastopirellula marina*, is shown in SEQ ID NO: 53 and the nucleotide sequence of the β-subunit gene of the same, which is located in the region from base position 2089 to 3108 (complementary strand) in the genomic sequence of *Blastopirellula marina*, is shown in SEQ ID NO: 55. Moreover, the amino acid sequence of the α-subunit of the α-ketoglutarate synthase encoded by the same gene is shown in SEQ ID NO: 54 and the amino acid sequence of the β-subunit of the same is shown in SEQ ID NO: 56. Moreover, the α-ketoglutarate synthase genes of *Hydrogenobacter thermophilus* (GenBank Accession No. AB046568) have been cloned (Yun, N. R. et al. 2001. Biochem. Biophy. Res. Commum. 282: 589-594) and the α-subunit (GenBank Accession No. BAB21494) and the β-subunit (GenBank Accession No. BAB21495) have been identified. Moreover, examples of α-ketoglutarate synthase genes include, for example, four genes located in the region from base position 620219 to 623070 in the genomic sequence of *Helicobacter pylori* (GenBank Accession No. NC_00091): HP0588, HP0589, HP0590, and HP0591; and two genes located in the region from base position 2575303 to 2578105 in the genomic sequence of *Sulfolobus solfataricus* (GenBank Accession No. NC_002754): SSO2815 and SSO2816.

Based on the homology with the above-described genes, α-ketoglutarate synthase genes cloned from bacteria in the genera *Chlorobium, Desulfobacter, Aquifex, Hydrogenobacter, Thermoproteus, Pyrobaculum, Sulfurimonas, Methanococcus*, and the like may also be used as an α-ketoglutarate synthase gene.

An α-subunit gene and β-subunit gene derived from the same organism for the α-ketoglutarate synthase can be used, but the genes may be individually derived from different organisms as long as a protein having the α-ketoglutarate synthase activity can be constructed. Examples of a particular combination include, but are not limited to, a combination of an α-subunit having the amino acid sequence of SEQ ID NO: 50 or a conservative variant thereof and a β-subunit having the amino acid sequence of SEQ ID NO: 52 or a conservative variant thereof, and a combination of an α-subunit having the amino acid sequence of SEQ ID NO: 54 or a conservative variant thereof and a β-subunit having the amino acid sequence of SEQ ID NO: 56 or a conservative variant thereof.

The increase in the α-ketoglutarate synthase activity can be confirmed, for example, by preparing crude enzyme solutions from microorganisms before and after the modification and comparing the α-ketoglutarate synthase activity in the crude enzyme solutions. The α-ketoglutarate synthase activity can be measured according to, for example, a method of Yun et al., (Yun, N. R. et al. 2001. Biochem. Biophy. Res. Commum. 282: 589-594). Specifically, the α-ketoglutarate synthase activity can be determined by adding α-ketoglutaric acid to a reaction liquid containing oxidized methyl viologen as an electron acceptor, CoA, and a crude enzyme solution and measuring spectroscopically the amount of reduced methyl viologen increasing due to the decarboxylation reaction of α-ketoglutaric acid. One unit (U) of the α-ketoglutarate synthase activity is defined as the activity for reducing 1 μmol of methyl viologen per one minute. The α-ketoglutarate synthase activity should be increased at least as compared to that of a non-modified strain. When a non-modified strain has the α-ketoglutarate synthase activity, the α-ketoglutarate synthase activity may be increased preferably 1.5 times or more, more preferably two times or more, and Furthermore preferably three times or more as compared to that of the non-modified strain. Moreover, when a non-modified strain does not have the α-ketoglutarate synthase activity, an α-ketoglutarate synthase should be produced by introducing α-ketoglutarate synthase genes, and the α-ketoglutarate synthase may be produced to such a degree that the enzymatic activity can be determined, or may be produced in an amount of preferably 0.001 U/mg or more, more preferably 0.005 U/mg or more, and Furthermore preferably 0.01 U/mg or more relative to the total protein in microbial cells.

Moreover, the microorganism of the present invention may have been modified to have an increased activity to regenerate the reduced form of an electron donor from the oxidized form of the electron donor, the reduced form being required for the α-ketoglutarate synthase activity. Such a modification may allow the α-ketoglutarate synthase activity to be increased. Examples of the activity to regenerate the reduced form of an electron donor from the oxidized form of the electron donor include the ferredoxin-NADP$^+$ reductase activity and the pyruvate synthase activity. The activity to regenerate the reduced form of an electron donor from the oxidized form of the electron donor can be increased, for example, by increasing the expression of a gene encoding a protein having such an activity. The increase in the activity to regenerate the reduced form of an electron donor from the oxidized form of the electron donor may or may not be combined with other modifications such as the increase in the expression of α-ketoglutarate synthase genes.

The term "ferredoxin-NADP⁺ reductase" refers to an enzyme which reversibly catalyzes the reaction below (EC 1.18.1.2):

reduced ferredoxin+NADP⁺→oxidized ferredoxin+ NADPH+H⁺.

In this reaction, ferredoxin can be substituted with flavodoxin. That is, ferredoxin-NADP⁺ reductase is synonymous with flavodoxin-NADP⁺ reductase. Moreover, ferredoxin-NADP⁺ reductase is also referred to as ferredoxin-NADP⁺ oxidoreductase, or NADPH-ferredoxin oxidoreductase. The above-described reaction is reversible and a ferredoxin-NADP⁺ reductase can regenerate the reduced ferredoxin and/or reduced flavodoxin from the oxidized form thereof in the presence of NADPH. That is, by using a combination of a ferredoxin-NADP⁺ reductase and an α-ketoglutarate synthase, the reduced ferredoxin and/or reduced flavodoxin which has been consumed by the α-ketoglutarate synthase can be regenerated via the reverse reaction of the ferredoxin-NADP⁺ reductase. The ferredoxin-NADP⁺ reductase activity can be increased, for example, by increasing the copy number or expression level of a gene encoding a ferredoxin-NADP⁺ reductase (ferredoxin-NADP⁺ reductase gene).

The presence of a ferredoxin-NADP⁺ reductase has been broadly identified from microorganisms to higher organisms (Carrillo, N. and Ceccarelli, E. A., Eur. J. Biochem. 270: 1900-1915 (2003); Ceccarelli, E. A., et al., Biochim. Biophys. Acta. 1698: 155-165 (2004)). Examples of a ferredoxin-NADP⁺ reductase gene include, for example, the fpr gene in Escherichia coli (Bianchi, V. et al. 1993. J. Bacteriol. 175:1590-1595), the ferredoxin-NADP⁺ reductase gene in Corynebacterium glutamicum, and the NADPH-putidaredoxin reductase gene in Pseudomonas putida (Koga, H. et al. 1989. J. Biochem. (Tokyo) 106: 831-836).

Specific examples of a flavodoxin-NADP⁺ reductase gene in Escherichia coli include the fpr gene having the nucleotide sequence of SEQ ID NO: 57 and located in the region from base position 4111749 to U.S. Pat. No. 4,112,495 (complementary strand) in the genomic sequence of the Escherichia coli strain K-12 (GenBank Accession No. U00096). The amino acid sequence of the Fpr protein (GenBank Accession No. AAC76906) encoded by the same gene is shown in SEQ ID NO: 58. Moreover, the ferredoxin-NADP⁺ reductase gene in Corynebacterium glutamicum (GenBank Accession No. BAB99777) has been identified in the region from base position 2526234 to 2527211 in the genomic sequence of Corynebacterium glutamicum (GenBank Accession No. BA00036).

The increase in the ferredoxin-NADP⁺ reductase activity can be confirmed, for example, by preparing crude enzyme solutions from microorganisms before and after the modification and comparing the ferredoxin-NADP⁺ reductase activity in the crude enzyme solutions. The ferredoxin-NADP⁺ reductase activity can be measured according to, for example, a method of Blaschkowski et al., (Blaschkowski, H. P. et al. 1982. Eur. J. Biochem. 123: 563-569). Specifically, the ferredoxin-NADP⁺ reductase activity can be determined by using ferredoxin as a substrate and measuring spectroscopically the amount of decreasing NADPH. One unit (U) of the ferredoxin-NADP⁺ reductase activity is defined as the activity for oxidizing 1 μmol of NADPH per one minute.

The term "pyruvate synthase" refers to an enzyme which reversibly catalyzes the reaction below for the production of pyruvic acid from acetyl-CoA and $CO_2$ by using reduced ferredoxin or reduced flavodoxin as an electron donor (EC 1.2.7.1):

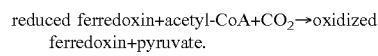
reduced ferredoxin+acetyl-CoA+$CO_2$→oxidized ferredoxin+pyruvate.

Pyruvate synthase is also referred to as pyruvate oxidoreductase, pyruvate ferredoxin reductase, pyruvate flavodoxin reductase, or pyruvate ferredoxin oxidoreductase. The above-described reaction is reversible and a pyruvate synthase can regenerate the reduced ferredoxin and/or reduced flavodoxin from the oxidized form thereof in the presence of pyruvic acid. That is, by using a combination of a pyruvate synthase and an α-ketoglutarate synthase, the reduced ferredoxin and/or reduced flavodoxin which has been consumed by the α-ketoglutarate synthase can be regenerated via the reverse reaction of the pyruvate synthase. The pyruvate synthase activity can be increased, for example, by increasing the copy number or expression level of a gene encoding a pyruvate synthase (pyruvate synthase gene).

Examples of a pyruvate synthase gene include the pyruvate synthase genes in bacteria possessing the reductive TCA cycle such as Chlorobium tepidum and Hydrogenobacter thermophilus; the pyruvate synthase genes in bacteria belonging to the family Enterobacteriaceae such as Escherichia coli; and the pyruvate synthase genes in autotrophic methanogens such as Methanococcus maripaludis, Methanocaldococcus jannaschii, and Methanothermobacter thermautotrophicus.

Specific examples of a pyruvate synthase gene in Chlorobium tepidum include a gene having the nucleotide sequence of SEQ ID NO: 59 and located in the region from base position 1534432 to 1537989 in the genomic sequence of Chlorobium tepidum (GenBank Accession No. NC_002932). The amino acid sequence of the pyruvate synthase (GenBank Accession No. AAC76906) encoded by the same gene is shown in SEQ ID NO: 60. Moreover, the pyruvate synthase of Hydrogenobacter thermophilus is known to form a four-subunit complex composed of the δ subunit (GenBank Accession No. BAA95604), the α-subunit (GenBank Accession No. BAA95605), the β-subunit (GenBank Accession No. BAA95606), and the γ subunit (GenBank Accession No. BAA95607) (Ikeda, T. et al. 2006. Biochem. Biophys. Res. Commun. 340: 76-82). Moreover, examples of a pyruvate synthase gene include, for example, four genes located in the region from base position 1170138 to 1173296 in the genomic sequence of Helicobacter pylori (GenBank Accession No. NC 000915): HP1108, HP1109, HP1110, and HP1111; and four genes represented by the region from base position 1047593 to 1044711 in the genomic sequence of Sulfolobus solfataricus (GenBank Accession No. NC 002754): SS01208, SS07412, SS01207, and SS01206.

Based on the homology with the above-described genes, pyruvate synthase genes cloned from bacteria in the genera Chlorobium, Desulfobacter, Aquifex, Hydrogenobacter, Thermoproteus, Pyrobaculum and the like may be used as a pyruvate synthase gene.

The increase in the pyruvate synthase activity can be confirmed by preparing crude enzyme solutions from microorganisms before and after the increase and comparing the pyruvate synthase activity in the crude enzyme solutions. The pyruvate synthase activity can be measured according to, for example, a method of Yoon et al., (Yoon, K. S. et al. 1997. Arch. Microbiol. 167: 275-279). The measurement principle is the same as that for the above-described measurement of the α-ketoglutarate synthase activity. Specifically, the pyruvate synthase activity can be determined by adding pyruvic acid to a reaction liquid containing oxidized methyl viologen as an electron acceptor, CoA, and a crude enzyme solution and measuring spectroscopically the amount of reduced methyl viologen increasing due to the decarboxylation reaction of the pyruvic acid. One unit (U) of the pyruvate synthase activity is defined as the activity for reducing 1 μmol of methyl viologen per one minute. The pyruvate synthase activity should be increased at least as compared to that of a non-modified strain. When a non-modified strain has the pyruvate synthase activity, the pyruvate synthase activity may be increased preferably 1.5 times or more, more preferably two times or more, and Furthermore preferably three times or more as compared to that of the non-modified strain. Moreover, when a non-modified strain does not have the pyruvate synthase activity, a pyruvate synthase should be produced by introducing a pyruvate synthase gene, and the pyruvate synthase may be produced to such a degree that the enzymatic activity can be determined, or may be produced in an amount of preferably 0.001 U/mg or more, more preferably 0.005 U/mg or more, and Furthermore preferably 0.01 U/mg or more relative to the total protein in microbial cells.

Moreover, the microorganism of the present invention may have been modified to have an increased ability to produce electron donor(s) required for the α-ketoglutarate synthase activity, that is, ferredoxin and/or flavodoxin. Such a modification may allow the α-ketoglutarate synthase activity to be increased. The ability to produce ferredoxin and/or flavodoxin can be increased, for example, by increasing the expression of a gene encoding a ferredoxin and/or flavodoxin. The increase of the ability to produce ferredoxin and/or flavodoxin may or may not be combined with other modifications such as the increase in the expression of α-ketoglutarate synthase genes.

The term "ferredoxin" refers to a protein which functions as a one-electron carrier containing an iron-sulfur cluster. The term "iron-sulfur cluster" refers to a cluster containing non-heme iron atoms and sulfur atoms and is referred to as 4Fe-4S, 3Fe-4S, or 2Fe-2S cluster according to the structure of the cluster. The term "flavodoxin" refers to a protein which functions as a one-electron or two-electron carrier containing FMN (flavin mononucleotide) as a prosthetic group. Ferredoxin and flavodoxin are described in the literature by McLean et al., (McLean, K. J. et al. 2005. Biochem. Soc. Trans. 33: 796-801).

Genes encoding ferredoxins (ferredoxin genes) and genes encoding flavodoxins (flavodoxin genes) are widely distributed in nature. Any ferredoxin gene or flavodoxin gene may be used as long as it encodes a ferredoxin or flavodoxin which can be used by an α-ketoglutarate synthase and an electron donor regeneration system. For example, in *Escherichia coli*, the fdx gene exists as a gene encoding a 2Fe-2S cluster-containing ferredoxin (Ta, D. T. and Vickery, L. E. 1992. J. Biol. Chem. 267:11120-11125) and the yfhL gene is presumed to be a gene encoding a 4Fe-4S cluster-containing ferredoxin. Moreover, as flavodoxin genes, the fldA gene (Osborne, C. et al. 1991. J. Bacteriol. 173: 1729-1737) and the fldB gene (Gaudu, P. and Weiss, B. 2000. J. Bacteriol. 182:1788-1793) are known to be present. In the genomic sequence of *Corynebacterium glutamicum* (GenBank Accession No. BA00036), the ferredoxin gene fdx (GenBank Accession No. BAB97942) is identified in the region from base position 562643 to 562963 and the fer gene (GenBank Accession No. BAB98495) is identified in the region from base position 1148953 to 1149270. Moreover, in *Chlorobium tepidum*, many ferredoxin genes exist and the genes for ferredoxin I and ferredoxin II have been identified as genes for 4Fe-4S-type ferredoxins which would be electron acceptors for a pyruvate synthase (Yoon, K. S. et al. 2001. J. Biol. Chem. 276: 44027-44036). Ferredoxin genes or flavodoxin genes derived from bacteria possessing the reductive TCA cycle, such as the ferredoxin gene in *Hydrogenobacter thermophilus*, may also be used.

Specific examples of a ferredoxin gene in *Escherichia coli* include the fdx gene shown in SEQ ID NO: 61 and located in the region from base position 2654770 to U.S. Pat. No. 2,655,105 (complementary strand) in the genomic sequence of the *Escherichia coli* strain K-12 (GenBank Accession No. U00096), and the yfhL gene shown in SEQ ID NO: 63 and located in the region from base position 2697685 to 2697945 in the same. The amino acid sequences of the Fdx protein and the YfhL protein encoded by the same genes are shown in SEQ ID NO: 62 and SEQ ID NO: 64 (GenBank Accession Nos. AAC75578 and AAC75615, respectively). Specific examples of a flavodoxin gene in *Escherichia coli* include the fldA gene shown in SEQ ID NO: 65 and located in the region from base position 710688 to 710158 (complementary strand) in the genomic sequence of the *Escherichia coli* strain K-12 (GenBank Accession No. U00096), and the fldB gene shown in SEQ ID NO: 67 and located in the region from base position 3037877 to 3038398 in the same. The amino acid sequences of the fldA protein and the fldB protein encoded by the same genes are shown in SEQ ID NO: 66 and SEQ ID NO: 68 (GenBank Accession Nos. AAC73778 and AAC75933, respectively). Specific examples of a ferredoxin gene in *Chlorobium tepidum* include the ferredoxin I gene shown in SEQ ID NO: 69 and located in the region from base position 1184078 to 1184266 in the genomic sequence of *Chlorobium tepidum* (GenBank Accession No. NC_002932) and the ferredoxin II gene shown in SEQ ID NO: 71 and located in base position 1184476 to 1184664 in the same. The amino acid sequences of ferredoxin I and ferredoxin II encoded by the same genes are shown in SEQ ID NO: 70 and SEQ ID NO: 72 (GenBank Accession Nos. AAM72491 and AAM72490, respectively). Moreover, examples of a ferredoxin gene include the ferredoxin gene in *Hydrogenobacter thermophilus* (GenBank Accession No. BAE02673) and the ferredoxin gene represented by the region from base position 2345414 to 2345728 in the genomic sequence of *Sulfolobus solfataricus*.

Based on the homology with the above-described genes, as a ferredoxin gene or flavodoxin gene, ferredoxin genes or flavodoxin genes cloned from bacteria in the genera *Chlorobium, Desulfobacter, Aquifex, Hydrogenobacter, Thermoproteus, Pyrobaculum* and the like may be used and ferredoxin genes or flavodoxin genes cloned from bacteria in γ-Proteobacteria such as the genera *Enterobacter, Klebsiella, Serratia, Erwinia*, and *Yersinia*; coryneform bacteria such as *Corynebacterium glutamicum* and *Brevibacterium lactofermentum*; *Pseudomonas* bacteria such as *Pseudomonas aeruginosa; Mycobacterium* bacteria such as *Mycobacterium tuberculosis*; and the like may be used.

The increase in the ability to produce ferredoxin and/or flavodoxin can be confirmed, for example, by measuring the expression level (the amount of mRNA or protein) or the activity of ferredoxin and/or flavodoxin. The activity of ferredoxin and flavodoxin each can be measured using a suitable redox reaction system. For example, the activity of ferredoxin can be measured by reducing ferredoxin with a ferredoxin-NADP$^+$ reductase and determining the amount of cytochrome c reduced by the resultant reduced ferredoxin (Boyer, M. E. et al. 2006. Biotechnol. Bioeng. 94: 128-138). Moreover, the activity of flavodoxin can be similarly measured.

Moreover, the microorganism of the present invention may have been modified to have a reduced α-ketoglutarate dehydrogenase (also referred to as "α-KGDH") activity. The term "α-ketoglutarate dehydrogenase" refers to an enzyme which catalyzes a reaction for the production of succinyl-CoA through the oxidative decarboxylation of α-ketoglutaric acid (2-oxoglutaric acid). Moreover, the activity to catalyze the same reaction is also referred to as "α-ketoglutarate dehydrogenase activity". α-KGDH is also referred to as oxoglutarate dehydrogenase or 2-oxoglutarate dehydrogenase.

The above-described reaction is catalyzed by three types of enzymes: α-KGDH (E1o; EC 1.2.4.2), dihydrolipoamide-S-succinyltransferase (E2o; EC 2.3.1.61), and dihydrolipoamide dehydrogenase (E3; EC 1.8.1.4). That is, these three types of enzymes catalyze the respective reactions below and the α-KGDH activity specifically refers to an activity to catalyze a reaction composed of these three reactions:

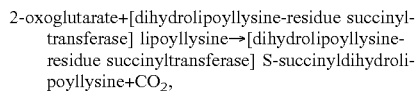  E1o:

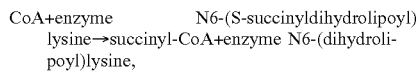  E2o:

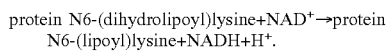  E3:

In Enterobacteriaceae, such as *Pantoea ananatis*, the subunit proteins E1o, E2o, and E3 having these three respective enzymatic activities form a complex. These respective subunits are encoded by the sucA, sucB, and lpdA genes, and the sucA and sucB genes are located downstream of the succinate dehydrogenase iron-sulfur protein gene (sdhB) (U.S. Pat. No. 6,331,419). Although, in the patent document, these genes are described to be genes in *Enterobacter agglomerans* AJ13355, this bacterial strain was reclassified later as *Pantoea ananatis*. As examples of genes encoding an α-KGDH of an enteric bacterium, the nucleotide sequences of the sucA, sucB, and lpdA genes in *Pantoea ananatis* AJ13355 are shown in SEQ ID NOs: 73, 75, and 77, respectively. Moreover, the amino acid sequences of the SucA, SucB, and LpdA proteins encoded by the same genes are shown in SEQ ID NOs: 74, 76, and 78, respectively. Moreover, the SucA, SucB, and LpdA proteins encoded by α-KGDH genes in *Escherichia coli*, that is, the sucA, sucB, and lpdA genes, are disclosed as GenBank NP_415254, NP_415255, and NP_414658, respectively.

Moreover, in a coryneform bacterium, the E1o subunit is encoded by the odhA gene (also referred to as sucA gene; registered as NCgl1084 in GenBank Accession No. NC_003450) and the E3 subunit is encoded by the lpd gene (GenBank Accession No. Y16642). Meanwhile, the E2o subunit is presumed to be encoded together with the E1o subunit by the odhA gene as a part of a bifunctional protein (see Usuda, Y. et al., Microbiology 1996. 142: 3347-3354) or to be encoded by a gene different from the odhA gene and registered as NCgl2126 in GenBank Accession No. NC_003450. Accordingly, in the present invention, though the odhA gene is a gene encoding the E1o subunit, it may also encode the E1o and E2o subunits together. The nucleotide sequence of the odhA gene in *Brevibacterium lactofermentum* ATCC 13032 and the amino acid sequence of the E1o subunit encoded by the same gene (WO2006/028298) are shown in SEQ ID NOs: 79 and 80, respectively. Moreover, the nucleotide sequence of the lpd gene of the same and the amino acid sequence of the E3 subunit encoded by the same gene (WO2006/028298) are shown in SEQ ID NOs: 81 and 82, respectively. Moreover, the nucleotide sequence of NCgl2126 with the above-described GenBank Accession No. NC_003450 and the amino acid sequence of the protein encoded by the same sequence are shown in SEQ ID NOs: 83 and 84, respectively.

The reduction in the α-KGDH activity can be confirmed by measuring the α-KGDH activity with a known method (Shiio, I. and Ujigawa-Takeda, K. 1980. Agric. Biol. Chem. 44: 1897-1904).

Moreover, the microorganism of the present invention may have been modified to have an increased ability to produce malyl-CoA. The term "an ability to produce malyl-CoA" as used herein refers to an ability to perform the biosynthesis of malyl-CoA and does not require the generated malyl-CoA to be accumulated inside or outside microbial cells as a product. That is, for example, the generated malyl-CoA may be consumed immediately.

The ability to produce malyl-CoA can be increased, for example, by (I) or (II) below:

(I) modifying a microorganism to have increased activities of enzyme(s) for synthesizing malyl-CoA from L-malic acid, malyl-CoA lyase, and isocitrate lyase; or (II) modifying a microorganism to have increased activities of enzyme(s) for synthesizing malyl-CoA from L-malic acid, malyl-CoA lyase, glyoxylate carboligase, and 2-hydroxy-3-oxopropionate reductase and/or hydroxypyruvate reductase (WO2013/018734).

The term "enzyme for synthesizing malyl-CoA from L-malic acid" refers to a protein having an activity to catalyze a reaction in which L-malic acid is converted to malyl-CoA through the association with CoA. Examples of an enzyme for synthesizing malyl-CoA from L-malic acid include malate thiokinase, succinyl-CoA synthase, and succinyl-CoA:malate-CoA-transferase. In the present invention, the activity of one or more types of enzymes selected from enzymes for synthesizing malyl-CoA from L-malic acid may be increased. That is, for example, the activity of any of malate thiokinase, succinyl-CoA synthase, and succinyl-CoA:malate-CoA-transferase may be increased, or the activity of all of them may be increased. The activity of a protein can be increased, for example, by increasing the expression of a gene encoding the same protein. Detailed procedures to increase the activity of a protein will be described below.

The term "malate thiokinase" refers to an enzyme which reversibly catalyzes a reaction for the production of malyl-CoA from L-malic acid and CoA (EC 6.2.1.9). Moreover, the activity to catalyze the same reaction is also referred to as "malate thiokinase activity". Additionally, the above-described reaction is known to be reversible in vivo and ex vivo, and that is, malate thiokinase is known to be able to catalyze the reverse reaction of the above-described reaction as well. Malate thiokinase is also referred to as malyl-CoA synthase, malate-CoA ligase, or malyl-coenzyme A synthase.

The malate thiokinase is known to function in a multi-subunit complex, usually a complex composed of an α-subunit and a β-subunit. The α-subunit is encoded by the mtkB gene and the β-subunit is encoded by the mtkA gene. The mtkA and mtkB genes are usually located sequentially on the genome.

Genes encoding malate thiokinases have been identified in organisms possessing an assimilation pathway for C1-carbon sources such as methane (J. Bacteriol., 176(23), 7398-7404 (1994)) and organisms possessing the 3-hydroxypropionate pathway (Arch. Microbiol., 151, 252-256 (1989)). Additionally, in general, there is the mclA gene encoding the malyl-CoA lyase described below in close proximity of the mtkAB genes on the genome encoding a malate thiokinase. Examples of a species in which the mkAB genes and the mclA gene are located in close proximity on the genome can be identified by, for example, NCBI BLAST (http://www.ncbi.nlm.nih.gov/BLAST/).

Specific examples of genes encoding a malate thiokinase include, for example, the mtkAB genes in *Methylobacterium* bacteria such as *Methylobacterium extorquens*; *Mesorhizobium* bacteria such as *Mesorhizobium loti*; *Granulibacter* bacteria such as *Granulibacter bethesdensis*; *Roseobacter* bacteria such as *Roseobacter denitrificans*; *Moorella* bacteria such as *Moorella thermoacetica*; *Hyphomicrobium* bacteria such as *Hyphomicrobium methylovorum*; *Chloroflexus* bacteria such as *Chloroflexus aurantiacus*; *Nitrosomonas* bacteria such as *Nitrosomonas europaea*; and *Methylococcus* bacteria such as *Methylococcus capsulatus*.

The entire nucleotide sequence of the genomic DNA of the *Methylobacterium extorquens* strain AM1 has been known (GenBank accession number NC_012808.1) and, furthermore, the nucleotide sequences of the mtkAB genes encoding the malate thiokinase in the *Methylobacterium extorquens* strain AM1 have been reported. That is, the mtkA gene in the *Methylobacterium extorquens* strain AM1 corresponds to a sequence from base position 1803549 to 1804721 in the genomic sequence of the *Methylobacterium extorquens* strain AM1 described in GenBank accession number NC_012808.1. Moreover, the mtkB gene in the *Methylobacterium extorquens* strain AM1 corresponds to a sequence from base position 1804744 to 1805634 in the genomic sequence of the *Methylobacterium extorquens* strain AM1 described in GenBank accession number NC_012808.1. The nucleotide sequence of the mtkA gene in the *Methylobacterium extorquens* strain AM1 and the amino acid sequence of the protein encoded by the same gene are shown in SEQ ID NOs: 99 and 100, respectively. The nucleotide sequence of the mtkB gene in the *Methylobacterium extorquens* strain AM1 and the amino acid sequence of the protein encoded by the same gene are shown in SEQ ID NOs: 101 and 102, respectively.

The entire nucleotide sequence of the genomic DNA of the *Mesorhizobium loti* strain MAFF303099 has been known (GenBank accession number NC_002678.2) and, furthermore, the nucleotide sequences of the mtkAB genes encoding the malate thiokinase in the *Mesorhizobium loti* strain MAFF303099 have been reported. That is, the mtkA gene and the mtkB gene in the *Mesorhizobium loti* strain MAFF303099 correspond to a sequence from base position 1110720 to 1111904 and a sequence from base position 1111919 to 1112818 in the genomic sequence of the *Mesorhizobium loti* strain MAFF303099 (GenBank accession number NC_002678.2), respectively. The nucleotide sequence of the mtkA gene in the *Mesorhizobium loti* strain MAFF303099 and the amino acid sequence of the protein encoded by the same gene are shown in SEQ ID NOs: 103 and 104, respectively. The nucleotide sequence of the mtkB gene in the *Mesorhizobium loti* strain MAFF303099 and the amino acid sequence of the protein encoded by the same gene are shown in SEQ ID NOs: 105 and 106, respectively.

The entire nucleotide sequence of the genomic DNA of the *Granulibacter bethesdensis* strain CGDNIH1 has been known (GenBank accession number NC_008343.1) and, furthermore, the nucleotide sequences of the mtkAB genes encoding the malate thiokinase in the *Granulibacter bethesdensis* strain CGDNIH1 have been reported. That is, the mtkA gene and the mtkB gene in the *Granulibacter bethesdensis* strain CGDNIH1 correspond to a sequence from base position 55236 to 56405 and a sequence from base position 56421 to 57317 in the genomic sequence of the *Granulibacter bethesdensis* strain CGDNIH1 (GenBank accession number NC_008343.1), respectively. The nucleotide sequence of the mtkA gene in the *Granulibacter bethesdensis* strain CGDNIH1 and the amino acid sequence of the protein encoded by the same gene are shown in SEQ ID NOs: 107 and 108, respectively. The nucleotide sequence of the mtkB gene in the *Granulibacter bethesdensis* strain CGDNIH1 and the amino acid sequence of the protein encoded by the same gene are shown in SEQ ID NOs: 109 and 110, respectively.

Any malate thiokinase genes can be used without any particular limitation as long as they encode proteins which function in a host. For example, genes encoding malate thiokinases of *Hyphomicrobium methylovolum*, *Hyphomicrobium denitrificans*, the *Rhizobium* sp. strain NGR234, *Granulibacter bethesdensis*, *Nitrosomonas europaea*, and *Methylococcus capsulatus* have been reported to be expressed and function in *E. coli*, *Pantoea ananatis*, and *Corynebacterium glutamicum* (WO2013/018734).

The α-subunit and the β-subunit of the malate thiokinase are highly homologous to the α-subunit and the β-subunit of a succinyl-CoA synthase as described below, respectively. As indicated in Examples section below, the inventors found that a succinyl-CoA synthase shows the malate thiokinase activity. It means that the malate thiokinase activity can also be increased by increasing the succinyl-CoA synthase activity.

The increase in the malate thiokinase activity can be confirmed, for example, by preparing crude enzyme solutions from microorganisms before and after the modification and comparing the malate thiokinase activity in the crude enzyme solutions. The malate thiokinase activity can be measured according to, for example, a method of Louis (Louis B. Hersh J Biol Chem. 1973 Nov. 10; 248(21):7295-303). Specifically, the malate thiokinase activity can be determined by adding L-malic acid to a reaction liquid containing phenylhydrazine, CoA, ATP, malyl-CoA lyase, and a crude enzyme solution, wherein phenylhydrazine quickly reacts with glyoxylic acid and gives a color, and measuring spectroscopically the amount of generated glyoxylate phenylhydrazine. This method utilizes a phenomenon that malyl-CoA generated by malate thiokinase is cleaved by malyl-CoA lyase into acetyl-CoA and glyoxylic acid.

The term "succinyl-CoA synthase" refers to an enzyme which catalyzes a reaction for the production of succinyl-CoA from succinic acid and coenzyme A (hereinafter referred to as CoA) accompanied by a hydrolysis reaction of nucleotide triphosphate, such as ATP or GTP, to nucleotide diphosphate and inorganic phosphate (EC 6.2.1.5 or EC 6.2.1.4). Moreover, the activity to catalyze the same reaction is also referred to as "succinyl-CoA synthase activity". Additionally, the above-described reaction is known to be reversible in vivo and ex vivo, and that is, the succinyl-CoA synthase is known to be able to catalyze the reverse reaction of the above-described reaction as well. Succinyl-CoA synthase is also referred to as succinyl-CoA ligase, succinyl-coenzyme A synthase, succinate thiokinase, succinic thiokinase, succinate phosphorylating enzyme, or P-enzyme.

The succinyl-CoA synthase is known to function in a multisubunit complex, usually a complex composed of an α-subunit and a β-subunit. The α-subunit is encoded by the sucD gene and the β-subunit is encoded by the sucC gene. The sucC and sucD genes are usually located sequentially on the genome.

The presence of genes encoding a succinyl-CoA synthase has been identified in various organisms. Genes encoding succinyl-CoA synthases have been registered in, for example, various databases such as KEGG (Kyoto Encyclopedia of Genes and Genomes; http://www.genome.jp/kegg/), NCBI (National Center for Biotechnology Information; http://www.ncbi.nlm.nih.gov/gene/), and BRENDA (BRaunschweig ENzyme DAtabase; http://www.brenda-enzymes.info/). Any succinyl-CoA synthase genes can be used without any particular limitation as long as they encode proteins which function in a host. Endogenous succinyl-CoA synthase genes in a host microorganism may also be used in terms of, for example, the efficiency of the succinyl-CoA production.

Specific examples of genes encoding a succinyl-CoA synthase include, for example, the sucCD genes of *Escherichia* bacteria such as *Escherichia coli*; *Pantoea* bacteria such as *Pantoea ananatis*; and *Corynebacterium* bacteria such as *Corynebacterium glutamicum*, *Corynebacterium efficiens*, *Corynebacterium ammoniagenes*.

The entire nucleotide sequence of the genomic DNA of the *Escherichia coli* strain MG1655 has been known (GenBank accession number NC_000913.3) and, furthermore, the nucleotide sequences of the sucCD genes encoding the succinyl-CoA synthase in the *Escherichia coli* strain MG1655 have been reported. That is, the sucC gene corresponds to a sequence from base position 762237 to 763403 in the genomic sequence of the *Escherichia coli* strain MG1655 described in GenBank accession number NC_000913.3. Moreover, the sucD gene corresponds to a sequence from base position 763403 to 764272 in the genomic sequence of the *Escherichia coli* strain MG1655 described in GenBank accession number NC_000913.3. The nucleotide sequence of the sucC gene in the *Escherichia coli* strain MG1655 and the amino acid sequence of the protein encoded by the same gene are shown in SEQ ID NOs: 111 and 112, respectively. The nucleotide sequence of the sucD gene in the *Escherichia coli* strain MG1655 and the amino acid sequence of the protein encoded by the same gene are shown in SEQ ID NOs: 113 and 114, respectively.

The entire nucleotide sequence of the genomic DNA of the *Pantoea ananatis* strain AJ13355 has been known (GenBank accession number NC_017531.1) and, furthermore, the nucleotide sequences of the sucCD genes encoding the succinyl-CoA synthase in the *Pantoea ananatis* strain AJ13355 have been reported. That is, the sucC gene corresponds to a sequence from base position 610188 to 611354 in the genomic sequence of the *Pantoea ananatis* strain AJ13355 described in GenBank accession number NC_017531.1. Moreover, the sucD gene corresponds to a sequence from base position 611354 to 612229 in the genomic sequence of the *Pantoea ananatis* strain AJ13355 described in GenBank accession number NC_017531.1. The nucleotide sequence of the sucC gene in the *Pantoea ananatis* strain AJ13355 and the amino acid sequence of the protein encoded by the same gene are shown in SEQ ID NOs: 115 and 116, respectively. The nucleotide sequence of the sucD gene in the *Pantoea ananatis* strain AJ13355 and the amino acid sequence of the protein encoded by the same gene are shown in SEQ ID NOs: 117 and 118, respectively.

The entire nucleotide sequence of the genomic DNA of the *Corynebacterium glutamicum* strain ATCC13032 has been known (GenBank accession number NC_003450.3) and, furthermore, the nucleotide sequences of the sucCD genes encoding the succinyl-CoA synthase in the *Corynebacterium glutamicum* strain ATCC13032 have been reported. That is, the sucC gene corresponds to a sequence complementary to a sequence from base position 2725382 to 2726578 in the genomic sequence of the *Corynebacterium glutamicum* strain ATCC13032 described in GenBank accession number NC_003450.3. Moreover, the sucD gene corresponds to a sequence complementary to a sequence from base position 2724476 to 2725360 in the genomic sequence of the *Corynebacterium glutamicum* strain ATCC13032 described in GenBank accession number NC_003450.3. The nucleotide sequence of the sucC gene in the *Corynebacterium glutamicum* strain ATCC13032 and the amino acid sequence of the protein encoded by the same gene are shown in SEQ ID NOs: 119 and 120, respectively. The nucleotide sequence of the sucD gene in the *Corynebacterium glutamicum* strain ATCC13032 and the amino acid sequence of the protein encoded by the same gene are shown in SEQ ID NOs: 121 and 122, respectively. The nucleotide sequence of the sucC gene in the *Corynebacterium glutamicum* strain 2256 (ATCC 13869) and the amino acid sequence of the protein encoded by the same gene are shown in SEQ ID NOs: 123 and 124, respectively. The nucleotide sequence of the sucD gene in the *Corynebacterium glutamicum* strain 2256 (ATCC 13869) and the amino acid sequence of the protein encoded by the same gene are shown in SEQ ID NOs: 125 and 126, respectively.

Additionally, the succinyl-CoA synthase activity and/or malate thiokinase activity may be increased by introducing a mutation into a succinyl-CoA synthase. Examples of a mutation which increases at least the malate thiokinase activity include, for example, the mutations below:

a mutation substituting proline at position 124 with alanine in the α-subunit encoded by the sucD gene of *Escherichia coli*;

a mutation substituting tyrosine at position 157 with glycine in the α-subunit encoded by the sucD gene of *Escherichia coli*;

a mutation substituting valine at position 161 with alanine in the α-subunit encoded by the sucD gene of *Escherichia coli*;

a mutation substituting glutamic acid at position 97 with aspartic acid in the α-subunit encoded by the sucD gene of *Escherichia coli*; and a mutation substituting glycine at position 271 with alanine in the β-subunit encoded by the sucC gene of *Escherichia coli*.

Only one of these mutations may be introduced, or two or more of the mutations may be introduced. For example, mutant succinyl-CoA synthase genes may be constructed, which has alanine residues substituted for valine at position 161 in the α-subunit encoded by the sucD gene of *Escherichia coli* and for glycine at position 271 in the β-subunit encoded by the sucC gene.

A succinyl-CoA synthase having none of the above-described mutations is referred to as "wild-type succinyl-CoA synthase" and a gene encoding a wild-type succinyl-CoA synthase is likewise referred to as "wild-type succinyl-CoA synthase gene". Moreover, a succinyl-CoA synthase having any of the above-described mutations is referred to as "mutant succinyl-CoA synthase" and a gene encoding a mutant succinyl-CoA synthase is likewise referred to as "mutant succinyl-CoA synthase gene".

The wild-type succinyl-CoA synthase is not limited to the wild-type succinyl-CoA synthase of *Escherichia coli* as indicated above and may also be a conservative variant thereof. Additionally, the position of mutation in the notation for each of the above-described mutations is a relative value and is variable depending on amino acid deletion, insertion, addition, or the like. For example, "valine at position 161 in the α-subunit" means an amino acid residue corresponding to the valine residue at position 161 in SEQ ID NO: 114. That is, "valine at position 161 in the α-subunit" is intended to be the 160th amino acid residue from the N-terminus in cases where one amino acid residue is deleted in a region on the N-terminal side to the position 161. Moreover, "valine at position 161 in the α-subunit" is intended to be the 162th amino acid residue from the N-terminus in cases where one amino acid residue is inserted to a region on the N-terminal side to the position 161.

The amino acid residues targeted to the above-described mutations in an arbitrary amino acid sequence can be determined by aligning the arbitrary amino acid sequence to the amino acid sequence of SEQ ID NO: 114. The alignment can be performed, for example, by using a known gene analysis software program. Specific examples of the software program include DNASIS produced by Hitachi Solutions, Ltd., GENETYX produced by GENETYX Co., and the like (Elizabeth C. Tyler et al., Computers and Biomedical Research, 24(1), 72-96, 1991; Barton G J et al., Journal of molecular biology, 198(2), 327-37. 1987).

The increase in the succinyl-CoA synthase activity can be confirmed, for example, by preparing crude enzyme solutions from microorganisms before and after the modification and comparing the succinyl-CoA synthase activity in the crude enzyme solutions. The succinyl-CoA synthase activity can be measured according to, for example, a method of Williamson (John R. Williamson, Barbara E. Corkey Methods in Enzymology, edited by Colowich J M. New York: Academic, 1969, p. 434-514). Specifically, the succinyl-CoA synthase activity can be determined by adding succinic acid to a reaction liquid containing CoA, ATP, phosphoenolpyruvic acid, pyruvate kinase, lactate dehydrogenase, NADH, and a crude enzyme solution and measuring spectroscopically the amount of consumed NADH.

The term "succinyl-CoA:malate-CoA-transferase" refers to an enzyme which catalyzes a reaction for the production of succinic acid and malyl-CoA from succinyl-CoA and L-malic acid (EC 2.8.3.-). Moreover, the activity to catalyze the same reaction is also referred to as "succinyl-CoA: malate-CoA-transferase activity". Succinyl-CoA:malate-CoA-transferase is also referred to as succinyl-CoA(S)-malate-CoA-transferase, or L-carnitine dehydratase/bile acid-inducible protein family.

Known examples of a succinyl-CoA:malate-CoA-transferase include a succinyl-CoA:malate-CoA-transferase which functions in a multisubunit complex. Such a succinyl-CoA:malate-CoA-transferase is usually composed of a subunit encoded by the smtA gene and a subunit encoded by the smtB gene. The smtA and smtB genes are usually located sequentially on the genome.

Specific examples of genes encoding such a succinyl-CoA:malate-CoA-transferase include, for example, the smtAB genes in *Chloroflexus* bacteria such as *Chloroflexus aurantiacus* and *Accumulibacter* bacteria such as *Accumulibacter phosphatis*, and homologs thereof. The proteins encoded by the smtA gene and the smtB gene are highly homologous to each other and, for example, proteins encoded by the smtA gene and the smtB gene of *Chloroflexus aurantiacus* have an amino acid homology of 59%. Additionally, the smtAB genes of *Chloroflexus aurantiacus* have been reported to be expressed and function in *E. coli* (Friedmann S et al. (2006) J Bacteriol. 188(7):2646-55).

Moreover, examples of a succinyl-CoA:malate-CoA-transferase also include a succinyl-CoA:malate-CoA-transferase encoded by a single gene. Such a succinyl-CoA: malate-CoA-transferase is not particularly limited as long as it is classified into CoA-transferase family III (CaiB/BaiF) and has the succinyl-CoA:malate-CoA-transferase activity.

Specific examples of a gene encoding such a succinyl-CoA:malate-CoA-transferase include, for example, the smtB gene homologs in *Magnetospirillum* bacteria such as *Magnetospirillum magneticum* and *Rhodospirillum* bacteria such as *Rhodospirillum rubrum*. Such a gene encoding a succinyl-CoA:malate-CoA-transferase is also referred to as "smt gene".

The entire nucleotide sequence of the genomic DNA of the *Chloroflexus aurantiacus* strain J-10-fl has been known (GenBank accession number NC_010175.1) and, furthermore, the nucleotide sequences of the smtAB genes encoding the succinyl-CoA:malate-CoA-transferase of the *Chloroflexus aurantiacus* strain J-10-fl (hereinafter also referred to as "Ca_smtAB genes") have been reported. That is, the Ca_smtA gene and the Ca_smtB gene correspond to a sequence complementary to a sequence from base position 224515 to 225882 and a sequence complementary to a sequence from base position 223035 to 224252 in the genomic sequence of the *Chloroflexus aurantiacus* strain J-10-fl (GenBank accession number NC_010175.1), respectively. The nucleotide sequence of the Ca_smtA gene and the amino acid sequence of the protein encoded by the same gene (YP_001633822) are shown in SEQ ID NOs: 127 and 128, respectively. The nucleotide sequence of the Ca_smtB gene and the amino acid sequence of the protein encoded by the same gene (YP_001633821) are shown in SEQ ID NOs: 129 and 130, respectively.

The entire nucleotide sequence of the genomic DNA of the Candidatus *Accumulibacter phosphatis* clade IIA strain UW-1 has been known (GenBank accession number NC_013194.1). Examples of the succinyl-CoA:malate-CoA-transferase genes in the Candidatus *Accumulibacter phosphatis* clade IIA strain UW-1 include the homologs of the Ca_smtA gene and the Ca_smtB gene (hereinafter also referred to as "Ap_smtA gene" and "Ap_smtB gene", respectively; as well as collectively referred to as "Ap_smtAB genes"). The Ap_smtA gene and the Ap_smtB gene correspond to a sequence from base position 2888316 to 2889563 and a sequence from base position 2889587 to 2890813 in the genomic sequence of the Candidatus *Accumulibacter phosphatis* clade IIA strain UW-1 (GenBank accession number NC_013194.1), respectively. The nucleotide sequence of the Ap_smtA gene and the amino acid sequence of the protein encoded by the same gene are shown in SEQ ID NOs: 131 and 132, respectively. The nucleotide sequence of the Ap_smtB gene and the amino acid sequence of the protein encoded by the same gene are shown in SEQ ID NOs: 133 and 134, respectively.

The entire nucleotide sequence of the genomic DNA of the *Rhodospirillum rubrum* strain ATCC 11170 has been known (GenBank accession number NC_007643.1). Examples of the succinyl-CoA:malate-CoA-transferase genes in the *Rhodospirillum rubrum* strain ATCC 11170 include a gene homologous to the Ca_smtB gene (hereinafter also referred to as "Rr_smt gene"). The Rr_smt gene corresponds to a sequence complementary to a sequence from base position 2965790 to 2967016 in the genomic sequence of the *Rhodospirillum rubrum* strain ATCC 11170 (GenBank accession number NC_007643.1). The nucleotide sequence of the Rr_smt gene and the amino acid sequence of the protein encoded by the same gene (YP_427637) are shown in SEQ ID NOs: 135 and 136, respectively.

The entire nucleotide sequence of the genomic DNA of the *Magnetospirillum magneticum* strain AMB-1 has been known (GenBank accession number NC_007626.1).

Examples of the succinyl-CoA:malate-CoA-transferase gene in the *Magnetospirillum magneticum* strain AMB-1 include a gene homologous to the Ca_smtB gene (hereinafter also referred to as "Mm_smt gene"). The Mm_smt gene corresponds to a sequence complementary to a sequence from base position 2307230 to 2308438 in the genomic sequence of the *Magnetospirillum magneticum* strain AMB-1 (GenBank accession number NC_007626.1). The nucleotide sequence of the Mm_smt gene and the amino acid sequence of the protein encoded by the same gene (YP_421496) are shown in SEQ ID NOs: 137 and 138, respectively.

The increase in the succinyl-CoA:malate-CoA-transferase activity can be confirmed, for example, by preparing crude enzyme solutions from microorganisms before and after the modification and comparing the succinyl-CoA: malate-CoA-transferase activity in the crude enzyme solutions. The succinyl-CoA:malate-CoA-transferase activity can be measured according to, for example, a method of Friedmann (Friedmann S et al. (2006) J Bacteriol. 188(7): 2646-55). Specifically, the succinyl-CoA:malate-CoA-transferase activity can be determined by adding L-malic acid to a reaction liquid containing phenylhydrazine, succinyl-CoA, malyl-CoA lyase, and a crude enzyme solution, wherein phenylhydrazine quickly reacts with glyoxylic acid and gives a color, and measuring spectroscopically the amount of generated glyoxylate phenylhydrazine.

The term "malyl-CoA lyase" refers to an enzyme which reversibly catalyzes a reaction for the production of acetyl-CoA and glyoxylic acid from malyl-CoA (EC 4.1.3.24). Moreover, the activity to catalyze the same reaction is also referred to as "malyl-CoA lyase activity". Malyl-CoA lyase is also referred to as malyl-coenzyme A lyase, or (3 S)-3-carboxy-3-hydroxypropanoyl-CoA glyoxylate-lyase.

Specific examples of a gene encoding a malyl-CoA lyase include, for example, the mclA genes in *Methylobacterium* bacteria such as *Methylobacterium extorquens*; *Mesorhizobium* bacteria such as *Mesorhizobium loti*; *Granulibacter* bacteria such as *Granulibacter bethesdensis*; *Roseobacter* bacteria such as *Roseobacter denitrificans*; *Moorella* bacteria such as *Moorella thermoacetica*; *Hyphomicrobium* bacteria such as *Hyphomicrobium methylovorum*; *Chloroflexus* bacteria such as *Chloroflexus aurantiacus*; *Nitrosomonas* bacteria such as *Nitrosomonas europaea*; and *Methylococcus* bacteria such as *Methylococcus capsulatus*.

The mclA gene encoding the malyl-CoA lyase in the *Methylobacterium extorquens* strain AM1 corresponds to a sequence from base position 1808790 to 1809764 in the genomic sequence of the *Methylobacterium extorquens* strain AM1 described in GenBank accession number NC_012808.1. The nucleotide sequence of the mclA gene in the *Methylobacterium extorquens* strain AM1 and the amino acid sequence of the protein encoded by the same gene are shown in SEQ ID NOs: 139 and 140, respectively.

The mclA gene encoding the malyl-CoA lyase in the *Mesorhizobium loti* strain MAFF303099 corresponds to a sequence from base position 1109744 to 1110700 in the genomic sequence of the *Mesorhizobium loti* strain MAFF303099 (GenBank accession number NC_002678.2). The nucleotide sequence of the mclA gene in the *Mesorhizobium loti* strain MAFF303099 and the amino acid sequence of the protein encoded by the same gene are shown in SEQ ID NOs: 141 and 142, respectively.

The DNA sequence of the mclA gene encoding the malyl-CoA lyase in the *Granulibacter bethesdensis* strain CGDNIH1 corresponds to a sequence from base position 60117 to 61112 in the genomic sequence of the *Granulibacter bethesdensis* strain CGDNIH1 (GenBank accession number NC_008343.1). The nucleotide sequence of the mclA gene in the *Granulibacter bethesdensis* strain CGDNIH1 and the amino acid sequence of the protein encoded by the same gene are shown in SEQ ID NOs: 143 and 144, respectively.

The increase in the malyl-CoA lyase activity can be confirmed, for example, by preparing crude enzyme solutions from microorganisms before and after the modification and comparing the malyl-CoA lyase activity in the crude enzyme solutions. The malyl-CoA lyase activity can be measured according to, for example, a method of Louis (Louis B. Hersh J Biol Chem. 1973 Nov. 10; 248(21):7295-303). Specifically, the malyl-CoA lyase activity can be determined by adding L-malic acid to a reaction liquid containing phenylhydrazine, CoA, ATP, malate thiokinase, and a crude enzyme solution, wherein phenylhydrazine quickly reacts with glyoxylic acid and gives a color, and measuring spectroscopically the amount of generated glyoxylate phenylhydrazine. This method utilizes a phenomenon that malyl-CoA generated by malate thiokinase is cleaved by malyl-CoA lyase into acetyl-CoA and glyoxylic acid. Alternatively, the malyl-CoA lyase activity can be determined similarly using malyl-CoA instead of the combination of CoA, ATP, malate thiokinase, and L-malic acid.

The term "isocitrate lyase" refers to an enzyme which reversibly catalyzes a reaction for the production of glyoxylic acid and succinic acid from isocitric acid (EC 4.1.3.1). Moreover, the activity to catalyze the same reaction is also referred to as "isocitrate lyase activity". Isocitrate lyase is also referred to as isocitrase, isocitritase, isocitratase, threo-Ds-isocitrate glyoxylate-lyase, or isocitrate glyoxylate-lyase.

The presence of a gene encoding an isocitrate lyase has been identified in various organisms. Genes encoding isocitrate lyases have been registered in, for example, various databases such as KEGG (Kyoto Encyclopedia of Genes and Genomes; http://www.genome.jp/kegg/), NCBI (National Center for Biotechnology Information; http://www.ncbi.nlm.nih.gov/gene/), and BRENDA (BRaunschweig ENzyme DAtabase; http://www.brenda-enzymes.info/). Any isocitrate lyase genes can be used without any particular limitation as long as they encode proteins which function in a host. Endogenous isocitrate lyase gene in a host microorganism may also be used in terms of, for example, the efficiency of the isocitrate lyase production.

Specific examples of a gene encoding an isocitrate lyase include, for example, the aceA genes in *Escherichia* bacteria such as *Escherichia coli*; *Pantoea* bacteria such as *Pantoea ananatis*; and *Corynebacterium* bacteria such as *Corynebacterium glutamicum*.

The aceA gene encoding the isocitrate lyase in the *Escherichia coli* strain MG1655 corresponds to a sequence from base position 4215132 to 4216436 in the genomic sequence of the *Escherichia coli* strain MG1655 described in GenBank accession number NC_000913.3. The nucleotide sequence of the aceA gene in the *Escherichia coli* strain MG1655 and the amino acid sequence of the protein encoded by the same gene are shown in SEQ ID NOs: 145 and 146, respectively.

The aceA gene encoding the isocitrate lyase in the *Pantoea ananatis* strain AJ13355 corresponds to a sequence from base position 4068278 to 4069579 in the genomic sequence of the *Pantoea ananatis* strain AJ13355 described in GenBank accession number NC_017531.1. The nucleotide sequence of the aceA gene in the *Pantoea ananatis* strain AJ13355 and the amino acid sequence of the protein encoded by the same gene are shown in SEQ ID NOs: 147 and 148, respectively.

Moreover, for example, some *Corynebacterium* bacteria have two copies of isocitrate lyase genes (hereinafter also referred to as "ICL1 gene" and "ICL2 gene"). The ICL1 gene in the *Corynebacterium glutamicum* strain ATCC13032 (Cgl2331) corresponds to a sequence from base position 2470741 to 2472039 in the genomic sequence of the *Corynebacterium glutamicum* strain ATCC13032 described in GenBank accession number NC_003450.3. The ICL2 gene in the *Corynebacterium glutamicum* strain ATCC13032 (Cgl0097) corresponds to a sequence complementary to a sequence from base position 106392 to 105838 in the genomic sequence of the *Corynebacterium glutamicum* strain ATCC13032 described in GenBank accession number NC_003450.3. The nucleotide sequence of the ICL1 gene in the *Corynebacterium glutamicum* strain ATCC13032 and the amino acid sequence of the protein encoded by the same gene are shown in SEQ ID NOs: 149 and 150, respectively. The nucleotide sequence of the ICL2 gene in the *Corynebacterium glutamicum* strain ATCC13032 and the amino acid sequence of the protein encoded by the same gene are shown in SEQ ID NOs: 151 and 152, respectively. Moreover, the nucleotide sequence of the ICL1 gene in the *Corynebacterium glutamicum* strain 2256 (ATCC 13869) and the amino acid sequence of the protein encoded by the same gene are shown in SEQ ID NOs: 153 and 154, respectively. The nucleotide sequence of the ICL2 gene in the *Corynebacterium glutamicum* strain 2256 (ATCC 13869) and the amino acid sequence of the protein encoded by the same gene are shown in SEQ ID NOs: 155 and 156, respectively.

The aceA gene is typically a component of an operon consisting of the aceBAK genes. As described below, the activity of a malate synthase encoded by the aceB can be attenuated. Therefore, when the isocitrate lyase activity is increased, the expression of the aceA gene may be increased, for example, by deleting the aceB gene in the aceBAK operon and introducing a strong promoter at the same time, as described in Examples section.

The increase in the isocitrate lyase activity can be confirmed, for example, by preparing crude enzyme solutions from microorganisms before and after the modification and comparing the isocitrate lyase activity in the crude enzyme solutions. The isocitrate lyase activity can be measured according to, for example, a method of Hoyt et al., (Hoyt J C et al. (1988) Biochim Biophys Acta. 14; 966(1):30-5). Specifically, the isocitrate lyase activity can be determined by adding isocitric acid to a reaction liquid containing phenylhydrazine and a crude enzyme solution, wherein phenylhydrazine quickly reacts with glyoxylic acid and gives a color, and measuring spectroscopically the amount of generated glyoxylate phenylhydrazine. Moreover, the isocitrate lyase activity can be measured according to, for example, a method of Mackintosh et al., (Mackintosh, C et al. (1988) Biochem. J. 250, 25-31). Specifically, the isocitrate lyase activity can be determined by adding glyoxylic acid and succinic acid to a reaction liquid containing NADP, isocitrate dehydrogenase, and a crude enzyme solution and measuring spectroscopically the amount of generated NADPH.

The term "glyoxylate carboligase" refers to an enzyme which catalyzes a reaction for converting two glyoxylic acid molecules to one 2-hydroxy-3-oxopropionic acid molecule (EC 4.1.1.47). The reaction is accompanied by decarboxylation of one carbon dioxide molecule. Examples of a gene encoding a glyoxylate carboligase include, for example, the gcl genes in *Corynebacterium* bacteria such as *Corynebacterium glutamicum*; *Escherichia* bacteria such as *Escherichia coli*; and *Rhodococcus* bacteria such as *Rhodococcus jostii*.

The term "2-hydroxy-3-oxopropionate reductase" refers to an enzyme which converts 2-hydroxy-3-oxopropionic acid to glyceric acid by using NADH as an electron donor (EC 1.1.1.60). Examples of a gene encoding a 2-hydroxy-3-oxopropionate reductase include, for example, the glxR genes in *Corynebacterium* bacteria such as *Corynebacterium glutamicum* and *Escherichia* bacteria such as *Escherichia coli*.

The term "hydroxypyruvate reductase" refers to an enzyme which converts hydroxypyruvic acid to glyceric acid by using NADH or NADPH as an electron donor (EC 1.1.1.81). Examples of a gene encoding a hydroxypyruvate reductase include, for example, the ycdW genes in *Escherichia* bacteria such as *Escherichia coli* and *Pantoea* bacteria such as *Pantoea ananatis*.

The genes used for these other modifications are not limited to the genes exemplified above and genes having a known nucleotide sequence, and may be variants thereof, so long as they encode proteins of which the original functions are maintained. For the variants of genes and proteins, the descriptions for conservative variants of the above-described dicarboxylic acid exporter proteins and the genes encoding them can be applied, mutatis mutandis.

The phrase "maintaining the original function" can mean that a variant of the protein has an activity which corresponds to the activity of the original protein. That is, for example, "retaining the original function" in terms of NADH dehydrogenase can mean that a protein has the NADH dehydrogenase activity and "retaining the original function" in terms of malate: quinone oxidoreductase can mean that a protein has the malate: quinone oxidoreductase activity. Additionally, in cases where a protein functions in a multisubunit complex, "retaining the original function" in terms of each subunit may mean that each subunit forms a complex with the remaining subunit(s) and the resultant complex has the corresponding activity. That is, for example, "retaining the original function" in terms of each subunit of NDH-1 may mean that each subunit forms a complex with the remaining subunits and the resultant complex has the NDH-1 activity.

<1-4> Methods for Increasing Activity of Protein

Hereafter, methods for increasing the activity of a protein will be explained.

The expression "the activity of a protein is increased" can mean that the activity of the protein per cell is increased as compared with that of a non-modified strain such as a wild-type strain and parent strain. The state that "the activity of a protein is increased" can also be expressed as "the activity of a protein is enhanced". Specifically, the expression "the activity of a protein is increased" can mean that the number of molecules of the protein per cell is increased, and/or the function of each molecule of the protein is increased as compared with those of a non-modified strain. That is, the term "activity" in the expression "the activity of a protein is increased" is not limited to the catalytic activity of the protein, but may mean the transcription amount of a gene (the amount of mRNA) coding for the protein, or the translation amount of the gene (the amount of the protein). Furthermore, the state that "the activity of a protein is increased" includes not only a state that the activity of an objective protein is increased in a strain inherently having the activity of the objective protein, but also a state that the activity of an objective protein is imparted to a strain not inherently having the activity of the objective protein. Furthermore, so long as the activity of the protein is eventually increased, the activity of the objective protein inherently contained in a microorganism may be reduced or eliminated, and then an appropriate type of the protein may be imparted thereto.

Although the degree of the increase in the activity of a protein is not particularly limited so long as the activity of the protein is increased as compared with a non-modified strain, the activity of the protein may be increased, for example, 1.5 times or more, 2 times or more, or 3 times or more, as compared with that of a non-modified strain. Furthermore, when the non-modified strain does not have the activity of the objective protein, it is sufficient that the protein is produced by introducing the gene coding for the protein, and for example, the protein may be produced to such an extent that the enzyme activity can be measured.

The modification that increases the activity of a protein can be attained by, for example, increasing the expression of a gene coding for the protein. The phrase that "the expression of a gene is increased" can also be referred to as "the expression of a gene is enhanced". The expression of a gene may be increased 1.5 times or more, 2 times or more, or 3 times or more, as compared with that observed in a non-modified strain. Furthermore, the phrase that "the expression of a gene is increased" can include not only when the expression amount of a target gene is increased in a strain that inherently expresses the target gene, but also when the gene is introduced into a strain that does not inherently express the target gene, and expressed therein. That is, the phrase "the expression of a gene is increased" also can mean, for example, that the target gene is introduced into a strain that does not have the gene, and expressed therein.

The expression of a gene can be increased by, for example, increasing the copy number of the gene.

The copy number of a gene can be increased by introducing the gene into the chromosome of a host microorganism. A gene can be introduced into a chromosome by, for example, using homologous recombination (Miller, J. H., Experiments in Molecular Genetics, 1972, Cold Spring Harbor Laboratory). Only one copy, or two or more copies of a gene may be introduced. For example, by performing homologous recombination using a sequence which is present in multiple copies on a chromosome as a target, multiple copies of a gene can be introduced into the chromosome. Examples of such a sequence which is present in multiple copies on a chromosome include repetitive DNAs, and inverted repeats located at the both ends of a transposon. Alternatively, homologous recombination may be performed by using an appropriate sequence on a chromosome such as a gene unnecessary for production of the objective substance as a target. Homologous recombination can be performed by, for example, a method of using a linear DNA such as Red-driven integration (Datsenko, K. A., and Wanner, B. L., Proc. Natl. Acad. Sci. USA, 97:6640-6645 (2000)), a method of using a plasmid having a temperature sensitive replication origin, a method of using a plasmid capable of conjugative transfer, a method of using a suicide vector not having a replication origin that functions in a host, or a transduction method using a phage. Furthermore, a gene can also be randomly introduced into a chromosome by using a transposon or Mini-Mu (Japanese Patent Laid-open (Kokai) No. 2-109985, U.S. Pat. No. 5,882,888, EP 805867 B1).

Introduction of a target gene into a chromosome can be confirmed by Southern hybridization using a probe having a sequence complementary to the whole gene or a part thereof, PCR using primers prepared on the basis of the sequence of the gene, or the like.

Furthermore, the copy number of a gene can also be increased by introducing a vector containing the target gene into a host microorganism. For example, the copy number of a target gene can be increased by ligating a DNA fragment containing the target gene with a vector that functions in a host microorganism to construct an expression vector of the gene, and transforming the host microorganism with the expression vector. The DNA fragment including the target gene can be obtained by, for example, PCR using the genomic DNA of a microorganism having the target gene as the template. As the vector, a vector autonomously replicable in the cell of the host microorganism can be used. The vector is preferably a multi-copy vector. Furthermore, the vector preferably has a marker such as an antibiotic resistance gene for selection of transformant. Furthermore, the vector may have a promoter and/or terminator for expressing the introduced gene. The vector may be, for example, a vector derived from a bacterial plasmid, a vector derived from a yeast plasmid, a vector derived from a bacteriophage, cosmid, phagemid, or the like. Specific examples of vector autonomously replicable in bacteria belonging to the family Enterobacteriaceae such as *Escherichia coli* include, for example, pUC19, pUC18, pHSG299, pHSG399, pHSG398, pACYC184, pBR322, pSTV29 (all of these are available from Takara Bio), pMW219 (NIPPON GENE), pTrc99A (Pharmacia), pPROK series vectors (Clontech), pKK233-2 (Clontech), pET series vectors (Novagen), pQE series vectors (QIAGEN), pACYC series vectors, and broad host-range vector RSF1010. Specific examples of vector autonomously replicable in coryneform bacteria include pHM1519 (Agric. Biol. Chem., 48, 2901-2903 (1984)); pAM330 (Agric. Biol. Chem., 48, 2901-2903 (1984)); plasmids obtained by improving these and having a drug resistance gene; plasmid pCRY30 described in Japanese Patent Laid-open (Kokai) No. 3-210184; plasmids pCRY21, pCRY2KE, pCRY2KX, pCRY31, pCRY3KE, and pCRY3KX described in Japanese Patent Laid-open (Kokai) No. 2-72876 and U.S. Pat. No. 5,185,262; plasmids pCRY2 and pCRY3 described in Japanese Patent Laid-open (Kokai) No. 1-191686; pAJ655, pAJ611, and pAJ1844 described in Japanese Patent Laid-open (Kokai) No. 58-192900; pCG1 described in Japanese Patent Laid-open (Kokai) No. 57-134500; pCG2 described in Japanese Patent Laid-open (Kokai) No. 58-35197; and pCG4 and pCG11 described in Japanese Patent Laid-open (Kokai) No. 57-183799.

When a gene is introduced, it is sufficient that the gene is able to be expressed by the microorganism of the present invention. Specifically, it is sufficient that the gene is introduced so that it is expressed under control of a promoter sequence that functions in the microorganism of the present invention. The promoter may be a promoter derived from the host, or a heterogenous promoter. The promoter may be the native promoter of the gene to be introduced, or a promoter of another gene. As the promoter, for example, a stronger promoter as described herein may also be used.

A terminator for termination of gene transcription may be located downstream of the gene. The terminator is not particularly limited so long as it functions in the microorganism of the present invention. The terminator may be a terminator derived from the host, or a heterogenous terminator. The terminator may be the native terminator of the gene to be introduced, or a terminator of another gene.

Specific examples of terminator include, for example, T7 terminator, T4 terminator, fd phage terminator, tet terminator, and trpA terminator.

Vectors, promoters, and terminators available in various microorganisms are disclosed in detail in "Fundamental Microbiology Vol. 8, Genetic Engineering, KYORITSU SHUPPAN CO., LTD, 1987", and those can be used.

Furthermore, when two or more of genes are introduced, it is sufficient that the genes each are able to be expressed by the microorganism of the present invention. For example, all the genes may be located on a single expression vector or a chromosome. Furthermore, the genes may be separately located on two or more expression vectors, or separately located on a single or two or more expression vectors and a chromosome. An operon made up of two or more genes may also be introduced.

The gene to be introduced is not particularly limited so long as it codes for a protein that functions in the host. The gene to be introduced may be a gene derived from the host, or may be a heterogenous gene. The gene to be introduced can be obtained by, for example, PCR using primers designed on the basis of the nucleotide sequence of the gene and the genomic DNA of an organism having the gene or a plasmid carrying the gene as a template. The gene to be introduced may also be totally synthesized, for example, on the basis of the nucleotide sequence of the gene (Gene, 60(1), 115-127 (1987)).

In addition, when a protein functions as a complex consisting of a plurality of subunits, a part or all of the plurality of subunits may be modified, so long as the activity of the protein is eventually increased. That is, for example, when the activity of a protein is increased by increasing the expression of a gene, the expression of a part or all of the genes that code for the subunits may be enhanced. It is usually preferable to enhance the expression of all of of the genes coding for the subunits. That is, for example, when the malate thiokinase activity is increased by increasing the expression of a malate thiokinase gene, the expression of either the mtkA or mtkB gene may be enhanced or both may be enhanced, which may be preferable. Also, for example, when the succinyl-CoA synthase activity is increased by increasing the expression of a succinyl-CoA synthase gene, the expression of either the sucC or sucD gene may be enhanced, or both may be enhanced, and which may be preferable. Also, for example, when the succinyl-CoA:malate-CoA-transferase activity is increased by increasing the expression of a succinyl-CoA:malate-CoA-transferase gene, the expression of either the smtA or smtB gene may be enhanced or both may be enhanced, which is preferable. Furthermore, the subunits constituting the complex may be derived from a single kind of organism or two or more kinds of organisms, so long as the complex has a function of the objective protein. That is, for example, genes of the same organism coding for a plurality of subunits may be introduced into a host, or genes of different organisms coding for a plurality of subunits may be introduced into a host.

Furthermore, the expression of a gene can be increased by improving the transcription efficiency of the gene. The transcription efficiency of a gene can be improved by, for example, replacing the promoter of the gene on a chromosome with a stronger promoter. The "stronger promoter" means a promoter providing an improved transcription of a gene compared with an inherent wild-type promoter of the gene. Examples of stronger promoters include, for example, the known high expression promoters such as T7 promoter, trp promoter, lac promoter, tac promoter, thr promoter, trc promoter, tet promoter, araBAD promoter, rpoH promoter, PR promoter, and PL promoter. Examples of stronger promoters usable in coryneform bacteria include the artificially modified P54-6 promoter (Appl. Microbiol. Biotechnolo., 53, 674-679 (2000)), pta, aceA, aceB, adh, and amyE promoters inducible in coryneform bacteria with acetic acid, ethanol, pyruvic acid, or the like, and cspB, SOD, and tuf promoters, which are potent promoters capable of providing a large expression amount in coryneform bacteria (Journal of Biotechnology, 104 (2003) 311-323; Appl. Environ. Microbiol., 2005 December; 71 (12):8587-96). Furthermore, as the stronger promoter, a highly-active type of an existing promoter may also be obtained by using various reporter genes. For example, by making the −35 and −10 regions in a promoter region closer to the consensus sequence, the activity of the promoter can be enhanced (WO00/18935). Examples of highly active-type promoter include various tac-like promoters (Katashkina J I et al., Russian Federation Patent Application No. 2006134574) and pnlp 8 promoter (WO2010/027045). Methods for evaluating the strength of promoters and examples of strong promoters are described in the paper of Goldstein et al. (Prokaryotic Promoters in Biotechnology, Biotechnol. Annu. Rev., 1, 105-128 (1995)), and so forth.

Furthermore, the expression of a gene can also be increased by improving the translation efficiency of the gene. The translation efficiency of a gene can be improved by, for example, replacing the Shine-Dalgarno (SD) sequence (also referred to as ribosome binding site (RBS)) for the gene on a chromosome with a stronger SD sequence. The "stronger SD sequence" means a SD sequence that provides an improved translation of mRNA compared with the inherent wild-type SD sequence of the gene. Examples of stronger SD sequences include, for example, RBS of the gene 10 derived from phage T7 (Olins P. O. et al, Gene, 1988, 73, 227-235). Furthermore, it is known that substitution, insertion, or deletion of several nucleotides in a spacer region between RBS and the start codon, especially in a sequence immediately upstream of the start codon (5'-UTR), significantly affects the stability and translation efficiency of mRNA, and hence, the translation efficiency of a gene can also be improved by modifying them.

Sites that affect the gene expression, such as a promoter, SD sequence, and spacer region between RBS and the start codon, are also collectively called "expression control regions". An expression control region can be identified by using a promoter search vector or gene analysis software such as GENETYX. Such an expression control region can be modified by, for example, a method of using a temperature sensitive vector or the Red driven integration method (WO2005/010175).

The translation efficiency of a gene can also be improved by, for example, modifying codons. In *Escherichia coli* etc., a clear codon bias exists among the 61 amino acid codons found within the population of mRNA molecules, and the level of cognate tRNA appears directly proportional to the frequency of codon usage (Kane, J. F., Curr. Opin. Biotechnol., 6 (5), 494-500 (1995)). That is, if there is a large amount of mRNA containing an excess amount of rare codons, a translational problem may arise. According to the recent research, it is suggested that clusters of AGG/AGA, CUA, AUA, CGA, or CCC codons may especially reduce both the quantity and quality of a synthesized protein. Such a problem occurs especially when expressing a heterologous gene. Therefore, in the case of heterogenous expression of a gene or the like, the translation efficiency of the gene can be improved by replacing a rare codon present in the gene with a synonymous codon more frequently used. Codons can be replaced by, for example, the site-specific mutation method for introducing an objective mutation into an objective site of DNA. Examples of the site-specific mutation method include the method utilizing PCR (Higuchi, R., 61, in PCR Technology, Erlich, H. A. Eds., Stockton Press (1989); Carter, P., Meth. in Enzymol., 154, 382 (1987)), and the method utilizing phage (Kramer, W. and Frits, H. J., Meth. in Enzymol., 154, 350 (1987); Kunkel, T. A. et al., Meth. in Enzymol., 154, 367 (1987)). Alternatively, a gene fragment in which objective codons are replaced may be totally synthesized. Frequencies of codons in various organisms are disclosed in the "Codon Usage Database" (http://www.kazusa.or.jp/codon; Nakamura, Y. et al, Nucl. Acids Res., 28, 292 (2000)).

Furthermore, the expression of a gene can also be increased by amplifying a regulator that increases the expression of the gene, or deleting or attenuating a regulator that reduces the expression of the gene.

Such methods for increasing the gene expression as mentioned above may be used independently or in an arbitrary combination.

Furthermore, a modification that increases the activity of a protein can also be attained by, for example, enhancing the specific activity of the enzyme. Enhancement of the specific activity also includes reduction or elimination of feedback inhibition. A protein showing an enhanced specific activity can be obtained by, for example, searching various organisms. Furthermore, a highly-active type of a native protein may also be obtained by introducing a mutation into the native protein. The mutation to be introduced may be, for example, substitution, deletion, insertion, or addition of one or several amino acid residues at one or several position of the protein. The mutation can be introduced by, for example, such a site-specific mutation method as mentioned above. The mutation may also be introduced by, for example, a mutagenesis treatment. Examples of the mutagenesis treatment include irradiation of X-ray, irradiation of ultraviolet, and a treatment with a mutation agent such as N-methyl-N'-nitro-N-nitrosoguanidine (MNNG), ethyl methanesulfonate (EMS), and methyl methanesulfonate (MMS). Furthermore, a random mutation may be induced by directly treating DNA in vitro with hydroxylamine. Enhancement of the specific activity may be independently used, or may be used in an arbitrary combination with such methods for enhancing gene expression as mentioned above.

The method for the transformation is not particularly limited, and conventionally known methods can be used. There can be used, for example, a method of treating recipient cells with calcium chloride so as to increase the permeability thereof for DNA, which has been reported for the *Escherichia coli* K-12 strain (Mandel, M. and Higa, A., J. Mol. Biol., 1970, 53, 159-162), and a method of preparing competent cells from cells which are in the growth phase, followed by transformation with DNA, which has been reported for *Bacillus subtilis* (Duncan, C. H., Wilson, G. A. and Young, F. E., Gene, 1977, 1:153-167). Alternatively, there can also be used a method of making DNA-recipient cells into protoplasts or spheroplasts, which can easily take up recombinant DNA, followed by introducing a recombinant DNA into the DNA-recipient cells, which is known to be applicable to *Bacillus subtilis*, actinomycetes, and yeasts (Chang, S. and Choen, S. N., 1979, Mol. Gen. Genet., 168:111-115; Bibb, M. J., Ward, J. M. and Hopwood, O. A., 1978, Nature, 274:398-400; Hinnen, A., Hicks, J. B. and Fink, G R., 1978, Proc. Natl. Acad. Sci. USA, 75:1929-1933). Furthermore, the electric pulse method reported for coryneform bacteria (Japanese Patent Laid-open (Kokai) No. 2-207791) can also be used.

An increase in the activity of a protein can be confirmed by measuring the activity of the protein.

An increase in the activity of a protein can also be confirmed by confirming an increase in the expression of a gene coding for the protein. An increase in the expression of a gene can be confirmed by confirming an increase in the transcription amount of the gene, or by confirming an increase in the amount of a protein expressed from the gene.

An increase of the transcription amount of a gene can be confirmed by comparing the amount of mRNA transcribed from the gene with that observed in a non-modified strain such as a wild-type strain or parent strain. Examples of the method for evaluating the amount of mRNA include Northern hybridization, RT-PCR, and so forth (Sambrook, J., et al., Molecular Cloning A Laboratory Manual/Third Edition, Cold spring Harbor Laboratory Press, Cold Spring Harbor (USA), 2001). The amount of mRNA may increase, for example, 1.5 times or more, 2 times or more, or 3 times or more, as compared with that of a non-modified strain.

An increase in the amount of a protein can be confirmed by Western blotting using antibodies (Molecular Cloning, Cold Spring Harbor Laboratory Press, Cold Spring Harbor (USA), 2001). The amount of the protein may increase, for example, 1.5 times or more, 2 times or more, or 3 times or more, as compared with that of a non-modified strain.

The aforementioned methods for increasing the activity of a protein can be applied to enhancement of the activity of an arbitrary protein such as α-ketoglutarate synthase, and enhancement of the expression of an arbitrary gene such as genes coding for the those arbitrary proteins.

<1-5> Method for Reducing Activity of Protein

Hereafter, methods for reducing the activity of a protein will be explained.

The expression "the activity of a protein is reduced" can mean that the activity of the protein per cell is decreased as compared with that of a non-modified strain such as a wild-type strain or parent strain, and includes a state that the activity has completely disappeared. Specifically, the expression "the activity of a protein is reduced" can mean that the number of molecules of the protein per cell is reduced, and/or the function of each molecule of the protein is reduced as compared with those of a non-modified strain. That is, the term "activity" in the expression "the activity of a protein is reduced" is not limited to the catalytic activity of the protein, but may mean the transcription amount of a gene (the amount of mRNA) coding for the protein or the translation amount of the protein (the amount of the protein). The phrase that "the number of molecules of the protein per cell is reduced" can also include the absence of any protein. The phrase that "the function of each molecule of the protein is reduced" can include when the function of each protein molecule completely disappears. Although the degree of the reduction in the activity of a protein is not particularly limited so long as the activity is reduced as compared with that of a non-modified strain, it may be reduced to, for example, 50% or less, 20% or less, 10% or less, 5% or less, or 0% of that of a non-modified strain.

The modification for reducing the activity of a protein can be attained by, for example, reducing the expression of a gene coding for the protein. The phrase that "the expression of a gene is reduced" can include when the gene is not expressed at all. The phrase that "the expression of a gene is reduced" can also be referred to as "the expression of a gene is attenuated". The expression of a gene may be reduced to 50% or less, 20% or less, 10% or less, 5% or less, or 0% of that of a non-modified strain.

The reduction in gene expression may be due to, for example, a reduction in the transcription efficiency, a reduction in the translation efficiency, or a combination of them. The expression of a gene can be reduced by modifying an expression control sequence of the gene such as a promoter and Shine-Dalgarno (SD) sequence. When an expression control sequence is modified, one or more nucleotides, two or more nucleotides, or three or more nucleotides, of the expression control sequence can be modified. Furthermore, a part of or the entire expression control sequence may be deleted. The expression of a gene can also be reduced by, for example, manipulating a factor responsible for expression control. Examples of the factor responsible for expression control include low molecules responsible for transcription or translation control (inducers, inhibitors, etc.), proteins responsible for transcription or translation control (transcription factors etc.), nucleic acids responsible for transcription or translation control (siRNA etc.), and so forth.

The modification for reducing the activity of a protein can also be attained by, for example, disrupting a gene coding for the protein. Disruption of a gene can be attained by, for example, deleting a part of or the entire coding region of the gene on a chromosome. Furthermore, entire genes including sequences upstream and downstream from the gene on a chromosome may be deleted. The region to be deleted may be any region such as an N-terminus region, an internal region, or a C-terminus region, so long as the activity of the protein can be reduced. Deletion of a longer region will usually more surely inactivate the gene. Furthermore, it is preferred that reading frames of the sequences upstream and downstream from the region to be deleted are not the same.

Disruption of a gene can also be attained by, for example, introducing a mutation for an amino acid substitution (missense mutation), a stop codon (nonsense mutation), a frame shift mutation which adds or deletes one or two nucleotide residues, or the like into the coding region of the gene on a chromosome (Journal of Biological Chemistry, 272:8611-8617 (1997); Proceedings of the National Academy of Sciences, USA, 95 5511-5515 (1998); Journal of Biological Chemistry, 26 116, 20833-20839 (1991)).

Disruption of a gene can also be attained by, for example, inserting another sequence into a coding region of the gene on a chromosome. Site of the insertion may be in any region of the gene, and insertion of a longer region will usually more surely inactivate the gene. It is preferred that reading frames of the sequences upstream and downstream from the insertion site are not the same. The other sequence is not particularly limited so long as a sequence that reduces or eliminates the activity of the encoded protein is chosen, and examples thereof include, for example, a marker gene such as antibiotic resistance genes, and a gene useful for production of an objective substance.

Such modification of a gene on a chromosome as described above can be attained by, for example, preparing a deficient-type gene in which a partial sequence of the gene is deleted so that it cannot produce a protein that can normally function, and transforming a microorganism with a recombinant DNA including the deficient-type gene to cause homologous recombination between the deficient-type gene and the wild-type gene on a chromosome and thereby substitute the deficient-type gene for the wild-type gene on the chromosome. In this procedure, if a marker gene selected according to the characteristics of the host such as auxotrophy is included in the recombinant DNA, the operation becomes easy. The protein encoded by the deficient-type gene has a conformation different from that of the wild-type protein, even if it is produced, and thus the function thereof is reduced or eliminated. Such gene disruption based on gene substitution utilizing homologous recombination has already been established, and there are methods of using a linear DNA such as a method called "Red driven integration" (Datsenko, K. A, and Wanner, B. L., Proc. Natl. Acad. Sci. USA, 97:6640-6645 (2000)), and a method utilizing the Red driven integration in combination with an excision system derived from λ phage (Cho, E. H., Gumport, R. I., Gardner, J. F., J. Bacteriol., 184:5200-5203 (2002)) (refer to WO2005/010175), a method of using a plasmid including a temperature sensitive replication origin, a method of using a plasmid capable of conjugative transfer, a method of utilizing a suicide vector not including a replication origin that functions in a host (U.S. Pat. No. 6,303,383, Japanese Patent Laid-open (Kokai) No. 05-007491), and so forth.

The modification for reducing the activity of a protein can also be attained by, for example, a mutagenesis treatment. Examples of the mutagenesis treatment include irradiation of X-ray, irradiation of ultraviolet, and treatment with a mutation agent such as N-methyl-N'-nitro-N-nitrosoguanidine (MNNG), ethyl methanesulfonate (EMS), and methyl methanesulfonate (MMS).

When a protein functions as a complex having a plurality of subunits, some or all of the subunits may be modified, so long as the activity of the protein is eventually reduced. That is, for example, some or all of the genes that code for the respective subunits may be disrupted or the like. Furthermore, when there is a plurality of isozymes of a protein, a part or all of the activities of the plurality of isozymes may be reduced, so long as the activity of the protein is eventually reduced. That is, for example, some or all of of the genes that code for the respective isozymes may be disrupted or the like.

A reduction in the activity of a protein can be confirmed by measuring the activity of the protein.

A reduction in the activity of a protein can also be confirmed by confirming a reduction in the expression of a gene encoding the protein. A reduction in the expression of a gene can be confirmed by confirming a reduction in the transcription amount of the gene or a reduction in the amount of the protein expressed from the gene.

A reduction in the transcription amount of a gene can be confirmed by comparing the amount of mRNA transcribed from the gene with that observed in a non-modified strain. Examples of the method for evaluating the amount of mRNA include Northern hybridization, RT-PCR, and so forth (Molecular Cloning, Cold spring Harbor Laboratory Press, Cold Spring Harbor (USA), 2001). The amount of mRNA can be decreased to, for example, 50% or less, 20% or less, 10% or less, 5% or less, or 0%, of that observed in a non-modified strain.

A reduction in the amount of a protein can be confirmed by Western blotting using antibodies (Molecular Cloning, Cold Spring Harbor Laboratory Press, Cold Spring Harbor (USA) 2001). The amount of the protein can be decreased to, for example, 50% or less, 20% or less, 10% or less, 5% or less, or 0%, of that observed in a non-modified strain.

Disruption of a gene can be confirmed by determining nucleotide sequence of a part or the whole of the gene, restriction enzyme map, full length, or the like of the gene depending on the means used for the disruption.

The aforementioned methods for reducing the activity of a protein can be applied to reduction in the activity of an arbitrary protein such as dicarboxylic acid exporter proteins, and reduction in the expression of an arbitrary gene such as genes coding for those arbitrary proteins.

<2> Method for Producing Objective Substance of the Present Invention

The methods of the present invention include a method for producing an objective substance by culturing the microorganism of the present invention in a medium to produce and accumulate the objective substance in the medium or in cells of the microorganism, and collecting the objective substance from the medium or the cells. One kind of objective substance may be produced, or two or more kinds or objective substances may be produced.

The medium is not particularly limited, so long as the microorganism of the present invention can proliferate in the medium and produce an objective substance. As the medium, for example, a typical medium used for culture of microorganisms such as bacteria can be used. As the medium, for example, a medium containing a carbon source, nitrogen source, phosphorus source, and sulfur source, as well as other components such as various organic components and inorganic components as required can be used. The types and concentrations of the medium components can be appropriately determined according to various conditions such as the type of the microorganism to be used and the type of the objective substance to be produced.

The carbon source is not particularly limited, so long as the microorganism of the present invention can utilize it and produce an objective substance. Specific examples of the carbon source include, for example, saccharides such as glucose, fructose, sucrose, lactose, galactose, xylose, arabinose, blackstrap molasses, hydrolysate of starches, and hydrolysate of biomass; organic acids such as acetic acid, fumaric acid, citric acid, succinic acid, and malic acid; alcohols such as ethanol, glycerol, and crude glycerol; and fatty acids. As the carbon source, plant-derived materials can be preferably used. Examples of the plant include, for example, corn, rice, wheat, soybean, sugarcane, beet, and cotton. Examples of the plant-derived materials include, for example, organs such as root, stem, trunk, branch, leaf, flower, and seed, plant bodies including them, and decomposition products of these plant organs. The forms of the plant-derived materials at the time of use thereof are not particularly limited, and they can be used in any form such as unprocessed product, juice, ground product, and purified product. Pentoses such as xylose, hexoses such as glucose, or mixtures of them can be obtained from, for example, plant biomass, and used. Specifically, these saccharides can be obtained by subjecting a plant biomass to such a treatment as steam treatment, hydrolysis with concentrated acid, hydrolysis with diluted acid, hydrolysis with an enzyme such as cellulase, and alkaline treatment. Since hemicellulose is generally more easily hydrolyzed compared with cellulose, hemicellulose in a plant biomass may be hydrolyzed beforehand to liberate pentoses, and then cellulose may be hydrolyzed to generate hexoses. Furthermore, xylose may be supplied by conversion from hexoses by, for example, imparting a pathway for converting hexose such as glucose to xylose to the microorganism of the present invention. As the carbon source, one kind of carbon source may be used, or two or more kinds of carbon sources may be used in combination.

The concentration of the carbon source in the medium is not particularly limited, so long as the microorganism of the present invention can proliferate and produce an objective substance. It is preferable to make the concentration of the carbon source in the medium as high as possible within such a range that production of the objective substance is not inhibited. Initial concentration of the carbon source in the medium may be, for example, usually 5 to 30% (w/v), preferably 10 to 20% (w/v). Furthermore, in accordance with consumption of the carbon source accompanying progress of the fermentation, the carbon source may be additionally added.

Specific examples of the nitrogen source include, for example, ammonium salts such as ammonium sulfate, ammonium chloride, and ammonium phosphate, organic nitrogen sources such as peptone, yeast extract, meat extract, and soybean protein decomposition product, ammonia, and urea. Ammonia gas and aqueous ammonia used for pH adjustment may also be used as a nitrogen source. As the nitrogen source, one kind of nitrogen source may be used, or two or more kinds of nitrogen sources may be used in combination.

Specific examples of the phosphate source include, for example, phosphate salts such as potassium dihydrogenphosphate and dipotassium hydrogenphosphate, and phosphoric acid polymers such as pyrophosphoric acid. As the phosphate source, one kind of phosphate source may be used, or two or more kinds of phosphate sources may be used in combination.

Specific examples of the sulfur source include, for example, inorganic sulfur compounds such as sulfates, thiosulfates, and sulfites, and sulfur-containing amino acids such as cysteine, cystine, and glutathione. As the sulfur source, one kind of sulfur source may be used, or two or more kinds of sulfur sources may be used in combination.

Specific examples of other various organic and inorganic components include, for example, inorganic salts such as sodium chloride and potassium chloride; trace metals such as iron, manganese, magnesium and calcium; vitamins such as vitamin B1, vitamin B2, vitamin B6, nicotinic acid, nicotinamide, and vitamin B12; amino acids; nucleic acids; and organic components containing these such as peptone, casamino acid, yeast extract, and soybean protein decomposition product. As the other various organic and inorganic components, one kind of component may be used, or two or more kinds of components may be used in combination.

Furthermore, when an auxotrophic mutant strain that requires an amino acid or the like for growth thereof is used, to the medium can be supplemented with the required nutrient. Furthermore, when L-glutamic acid is produced by using a coryneform bacterium, it is preferable to, for example, restrict the amount of biotin in the medium, or add a surfactant or penicillin to the medium. Furthermore, in order to prevent foaming during the culture, it is preferable to add an appropriate amount of a commercially-available antifoaming agent to the medium.

Culture conditions are not particularly limited, so long as the microorganism of the present invention can proliferate and produce an objective substance. The culture can be performed with, for example, usual conditions used for culture of microorganisms such as bacteria. The culture conditions may be appropriately determined according to various conditions such as the type of the microorganism to be used and the type of the objective substance to be produced.

The culture can be performed by using a liquid medium. At the time of the culture, the microorganism of the present invention cultured on a solid medium such as agar medium may be directly inoculated into a liquid medium, or the microorganism of the present invention cultured in a liquid medium as seed culture may be inoculated into a liquid medium for main culture. That is, the culture may be performed separately as seed culture and main culture. The amount of the microorganism of the present invention contained in the medium at the time of the start of the culture is not particularly limited. For example, seed culture showing an OD660 of 4 to 8 may be added to a medium for main culture at a ratio of 0.1 to 30 mass %, or 1 to 10 mass %, at the time of the start of the culture.

The culture can be performed as batch culture, fed-batch culture, continuous culture, or a combination of these. Furthermore, when the culture is performed separately as seed culture and main culture, the culture schemes of the seed culture and the main culture may be or may not be the same. For example, both the seed culture and the main culture may be performed as batch culture. Alternatively, for example, the seed culture may be performed as batch culture, and the main culture may be performed as fed-batch culture or continuous culture.

The culture may be performed under an aerobic condition, microaerobic condition, or anaerobic condition. The culture can be performed under a microaerobic condition or anaerobic condition. The aerobic condition means that dissolved oxygen concentration in the liquid medium is not lower than 0.33 ppm, which is the detection limit for the detection with an oxygen membrane electrode, preferably not lower than 1.5 ppm. The microaerobic condition means that, although oxygen is supplied to the culture system, dissolved oxygen concentration in the liquid medium is lower than 0.33 ppm. The anaerobic condition means that oxygen is not supplied to the culture system. The culture may be performed under the condition chosen above during the entire culture period, or during only a part of the culture period. That is, "to culture under an aerobic condition" means that the culture is performed under an aerobic condition during at least a part of the culture period. Furthermore, "to culture under a microaerobic condition" means that the culture is performed under a microaerobic condition during at least a part of the culture period. Furthermore, "to culture under an anaerobic condition" means that the culture is performed under an anaerobic condition during at least a part of the culture period. The "part of the culture period" may be, for example, a period of 50% or more, 70 or more, 80% or more, 90% or more, 95% or more, or 99% or more, of the whole culture period. When the culture is performed separately as seed culture and main culture, the "entire culture period" may mean the entire period of the main culture. Specifically, the culture under an aerobic condition can be performed by aeration culture or shaking culture. The microaerobic condition or anaerobic condition can be attained by means of reducing aeration volume or stirring velocity, performing the culture in a sealed vessel without aeration, aerating an inert gas containing carbon dioxide gas, or the like to reduce dissolved oxygen concentration in the liquid medium.

The pH of the medium may be, for example, 3 to 10, or 4.0 to 9.5. The pH of the medium can be adjusted during the culture as required. The pH of the medium can be adjusted by using various alkaline and acidic substances such as ammonia gas, aqueous ammonia, sodium carbonate, sodium bicarbonate, potassium carbonate, potassium bicarbonate, magnesium carbonate, sodium hydroxide, calcium hydroxide, and magnesium hydroxide.

The medium may contain carbonate ions, bicarbonate ions, carbon dioxide gas, or a combination of these. These components can be supplied, for example, by metabolism of the microorganism of the present invention, or from carbonate salt and/or bicarbonate salt used for pH adjustment. These components may also be supplied from carbonic acid, bicarbonic acid, salts thereof, or carbon dioxide gas, as required. Specific examples of salts of carbonic acid or bicarbonic acid include, for example, calcium carbonate, magnesium carbonate, ammonium carbonate, sodium carbonate, potassium carbonate, ammonium bicarbonate, sodium bicarbonate, and potassium bicarbonate. Carbonate ions and/or bicarbonate ions may be added at a concentration of 0.001 to 5 M, 0.1 to 3 M, 1 to 2 M. When carbon dioxide gas is contained, carbon dioxide gas may be contained in an amount of 50 mg to 25 g, 100 mg to 15 g, or 150 mg to 10 g, per litter of the solution.

The culture temperature may be, for example, 20 to 45° C., or 25 to 37° C. The culture time may be, for example, 1 hour or longer, 4 hours or longer, 10 hours or longer, or 15 hours or longer, and may be 168 hours or shorter, 120 hours or shorter, 90 hours or shorter, or 72 hours or shorter. Specifically, the culture time may be, for example, 10 to 120 hours. The culture may be continued, for example, until the carbon source contained in the medium is consumed, or until the activity of the microorganism of the present invention is lost.

By culturing the microorganism of the present invention under such conditions as described above, an objective substance can be accumulated in the medium or in cells of the microorganism.

Moreover, when L-glutamic acid is produced, the culture can be performed while precipitating L-glutamic acid in the medium by using a liquid medium adjusted to satisfy a condition under which L-glutamic acid precipitates. Examples of the condition under which L-glutamic acid precipitates include, for example, pH of 5.0 to 3.0, pH 4.9 to 3.5, pH 4.9 to 4.0, or about pH 4.7 (European Patent Laid-open No. 1078989). The total period or a partial period of the culture may be performed at the aforementioned pH. The "partial period" may be a period such as exemplified above.

Production of an objective substance can be confirmed by known methods used for detection or identification of compounds. Examples of such methods include, for example, HPLC, LC/MS, GC/MS, and NMR. These methods can be independently used, or can be used in an appropriate combination.

The produced objective substance can be collected by known methods used for separation and purification of compounds. Examples of such methods include, for example, ion-exchange resin method, membrane treatment, precipitation, and crystallization. These methods can be independently used, or can be used in an appropriate combination. When an objective substance is accumulated in cells of the microorganism, the cells can be disrupted with, for example, ultrasonic waves or the like, and then the objective substance can be collected by the ion exchange resin method or the like from supernatant obtained by removing the cells from the cell-disrupted suspension by centrifugation. The collected objective substance may be a free compound, a salt thereof, or a mixture of them. That is, the term "objective substance" used in the present invention may mean an objective substance in the free form, a salt thereof, or a mixture of them, unless otherwise stated. Examples of the salt include, for example, sulfate salt, hydrochloride salt, carbonate salt, ammonium salt, sodium salt, and potassium salt. For example, L-glutamic acid may also be L-glutamic acid in the free form, monosodium glutamate (MSG), monoammonium glutamate, or a mixture thereof. For example, in the case of L-glutamic acid, monosodium L-glutamate (MSG) can be obtained by crystalizing monoammonium L-glutamate in the fermentation broth by addition of an acid, and then by adding an equimolar of sodium hydroxide to the crystal. In addition, decolorization can be performed by using activated carbon before and/or after the crystallization (see, Tetsuya KAWAKITA, "Industrial Crystallization for Monosodium L-Glutamate.", Bulletin of the Society of Sea Water Science, Japan, Vol. 56:5).

Furthermore, when the objective substance precipitates into the medium, it can be collected by centrifugation or filtration. An objective substance precipitated into the medium and an objective substance dissolved in the medium may be isolated together after the objective substance dissolved in the medium is crystallized.

Moreover, in cases where an objective substance is volatile, the objective substance may be volatilized and collected. For example, an objective substance can be efficiently volatilized and separated from a culture broth by aeration culture. The method for collecting the volatilized objective substance is not particularly limited. For example, the volatilized objective substance may be accommodated in a collecting member such as a sealed vessel for general use or may be trapped in a proper liquid. Specifically, for example, a method of trapping isopropyl alcohol or acetone in a liquid to thereby collect it is disclosed in WO2009/008377. Moreover, examples of a machine appropriate in such a method include, for example, a culturing apparatus described in FIG. 1 of WO2009/008377.

The collected objective substance may contain, for example, cells of the microorganism, medium components, moisture, and by-product metabolites of the microorganism, in addition to the objective substance. Purity of the collected objective substance may be, for example, 30% (w/w) or higher, 50% (w/w) or higher, 70% (w/w) or higher, 80% (w/w) or higher, 90% (w/w) or higher, or 95% (w/w) or higher.

When the objective substance is L-glutamic acid, for example, the monosodium L-glutamate crystal can be used as an umami seasoning. The monosodium L-glutamate crystal can be used as a seasoning in combination with a nucleic acid such as 5'-GMP disodium salt and 5'-IMP disodium salt, which also have umami taste.

EXAMPLES

Hereafter, the present invention will be more specifically explained with reference to examples. However, the present invention is not limited by these examples.

Example 1: Effects of Dicarboxylic Acid Exporter Protein Deficiency in Glutamate Production by *E. coli* (1)

In this Example, dicarboxylic acid exporter gene-deficient strains derived from *E. coli* MG1655 (ATCC 47076) were constructed to produce glutamic acid.

<1-1> Construction of the MG1655 ΔsucA ΔgadA ΔgadB Strain

The gadA and gadB genes on the genome (chromosome) of the *E. coli* MG1655 ΔsucA strain (WO2007/125954) were deleted to construct the MG1655 ΔsucA ΔgadA ΔgadB strain. The gene deletion was performed with a combination method of "Red-driven integration" (Proc. Natl. Acad. Sci. USA, 2000, vol. 97, No. 12, p 6640-6645) and the excision system originated from lambda phage (J. Bacteriol. 2002 September; 184(18): 5200-3. Interactions between integrase and excisionase in the phage lambda excisive nucleoprotein complex. Cho E H, Gumport R I, Gardner J F) (hereinafter also referred to as "λ-Red method"; WO2005/010175). Experimental procedures will be shown below.

A PCR reaction was performed using H70 (SEQ ID NO: 181) and H71 (SEQ ID NO: 182) (each containing a partial sequence of the gadB gene and either the attL sequence or the attR sequence) as primers and pMW118-attL-Cm-attR (WO2005/010175) as a template. The obtained DNA fragment was digested with DpnI restriction enzyme and introduced by electroporation to the MG1655 ΔsucA strain containing the plasmid pKD46, which has an ability to replicate in a thermo-sensitive manner (Proc. Natl. Acad. Sci. USA, 2000, vol. 97, No. 12, p 6640-6645). Chloramphenicol-resistant recombinants were selected by culturing at 30° C. on LB-agar medium containing Amp (ampicillin; 50 mg/L) and Cm (chloramphenicol; 20 mg/L). A colony PCR was performed using H72 (SEQ ID NO: 183) and H73 (SEQ ID NO: 184) as primers to select a recombinant strain carrying gadB::Cm. The selected strain was named MG1655 ΔsucA gadB::Cm.

Next, a PCR reaction was performed using H66 (SEQ ID NO: 185) and H67 (SEQ ID NO: 186) (each containing a partial sequence of the gadA gene and either the attL sequence or the attR sequence) as primers and pMW118-attL-Km-attR as a template. The obtained DNA fragment was digested with DpnI restriction enzyme and introduced by electroporation to the MG1655 ΔsucA gadB::Cm strain containing pKD46. Kanamycin-resistant recombinants were selected by culturing at 37° C. on LB-agar medium containing 50 mg/L of kanamycin (Km) and 25 mg/L of Cm. A colony PCR was performed using H68 (SEQ ID NO: 187) and H69 (SEQ ID NO: 188) as primers to select a recombinant strain carrying gadA::Km. The selected strain was named MG1655 ΔsucA gadA::Km gadB::Cm. An Amps strain was selected by single-colony isolation at 37° C., and the pMW-int-xis plasmid (WO2007/037460) was introduced to the Amps strain by electroporation, and strains resistant to Amp were selected at 30° C., followed by single-colony isolation of the obtained strains at 42° C. to obtain a strain of interest which had lost the drug-resistance cassettes and the plasmid: the MG1655 ΔsucA ΔgadA ΔgadB strain.

<1-2> Construction of the MG1655 ΔsucA ΔgadA ΔgadB ΔiscR Δldh ΔpflD ΔpflB strain In the above-obtained MG1655 ΔsucA ΔgadA ΔgadB strain, the iscR, ldh, pflD, and pflB genes on the genome were further deleted to construct the MG1655 ΔsucA ΔgadA ΔgadB ΔiscR Δldh ΔpflD ΔpflB strain. This strain was produced by preparing P1 phage from strains deficient in the respective genes in the Keio collection (Baba, T., Ara, T., Hasegawa, M., Takai, Y, Okumura, Y, Baba, M., Datsenko, K. A., Tomita, M., Wanner, B. L., and Mori, H. (2006) Construction of *Escherichia coli* K-12 in-frame, single-gene knockout mutants: the Keio collection. Mol Syst Biol 2: 2006 0008) and repeatedly performing P1 transformation to the corresponding strain of interest, and subsequent deletion of a drug-resistance gene used as a selection marker.

Specifically, at first, P1 transduction was performed using the *E. coli* BW25113 iscR::Kmr strain [rrnB3 ΔlacZ4787 hsdR514 Δ(araBAD)567 Δ(rhaBAD)568 rph-1 iscR::Kmr] in the Keio collection as a donor and MG1655 ΔsucA ΔgadA ΔgadB as a recipient to obtain MG1655 ΔsucA ΔgadA ΔgadB ΔiscR::Kmr. Then, a plasmid carrying a FLP recombinase gene, pMAN-FLP, was introduced to this strain to delete the Kmr gene with a method described in Datsenko (Proc. Natl. Acad. Sci. USA, 2000, vol. 97, No. 12, p 6640-6645) and obtain MG1655 ΔsucA ΔgadA ΔgadB ΔiscR.

The above-used pMAN-FLP was produced by the following procedures. That is, pCP20 (PNAS 97: 6640-6645 (2000)) was treated with SmaI and BamHI restriction enzymes to obtain a 3.3 kb fragment containing the FRT-specific Flp recombinase gene. The obtained DNA fragment was cloned into the SmaI and BamHI sites in the multi-cloning site of the pMAN997 vector (J. Bacteriol. 2001, 183(22):6538) to construct pMAN-FLP.

The genes ldh, pflD, and pflB were also deleted sequentially by repeating the similar operations to eventually obtain the MG1655 ΔsucA ΔgadA ΔgadB ΔiscR Δldh ΔpflD ΔpflB strain.

<1-3> Construction of the MG1655 ΔsucA ΔgadA ΔgadB ΔiscR Δldh ΔpflD ΔpflB Δicd Strain MG1655 Δicd::Cm is produced by the λ-Red method. A PCR reaction is performed using 51 and S2 (each containing a partial sequence of the icd gene and either the attL sequence or the attR sequence) as primers and pMW118-attL-Cm-attR as a template. The obtained DNA fragment is digested with DpnI and introduced by electroporation to the MG1655 strain containing the plasmid pKD46, which has an ability to replicate in a thermo-sensitive manner. Cm-resistant recombinants are selected by culturing at 30° C. on LB-agar medium containing 50 mg/L of Amp and 20 mg/L of Cm. A colony PCR is performed using the S3 and S4 primers to select a recombinant strain carrying icd::Cm. The selected strain is named MG1655 Δicd::Cm.

P1 transduction is performed using MG1655 Δicd::Cm as a donor and MG1655 ΔsucA ΔgadA ΔgadB ΔiscR Δldh ΔpflD ΔpflB as a recipient to obtain MG1655 ΔsucA ΔgadA ΔgadB ΔiscR Δldh ΔpflD ΔpflB Δicd::Cm. Then, the pMW-int-xis plasmid is introduced to this strain by electroporation, and strains resistant to Amp are selected at 30° C., followed by single-colony isolation of the obtained strains at 42° C. to obtain a strain of interest which had lost the drug-resistance cassette and the plasmid: the MG1655 ΔsucA ΔgadA ΔgadB ΔiscR Δldh ΔpflD ΔpflB Δicd strain. This strain is named E7-39 strain.

<1-4> Construction of a ΔyeeA Strain, a ΔynfM Strain, a ΔyjjP Strain, and a ΔyjjB Strain MG1655 ΔyeeA::Cm was produced by the λ-Red method. A PCR reaction was performed using the primer DEco yeeA-Fw (GGCCGACAGATGAGTTATGAGCGCTTT-TAATCTCATTACGGAGTTTCTGCTG AAGCCT-GCTTTTTTATACTAAGTTGGCA; SEQ ID NO: 221) and the primer DEco yeeA-Rv (TTATCCTTGCTGAATC-GAAGCAGCAGCAAGATGATTCTGAAGTTCAG-GAACG CTCAAGTTAGTATAAAAAAGCTGAACGA; SEQ ID NO: 222) (each containing a partial sequence of the yeeA gene and either the attL sequence or the attR sequence) and pMW118-attL-Cm-attR as a template. The obtained DNA fragment was digested with DpnI restriction enzyme and introduced by electroporation to the MG1655 strain containing the plasmid pKD46, which has an ability to replicate in a thermo-sensitive manner. Cm-resistant recombinants were selected by culturing at 30° C. on LB-agar medium containing 50 mg/L of Amp and 20 mg/L of Cm. A colony PCR was performed using the primer DEco yeeA-CF (ATTACACTGTTCCCGGTTTGTCCGTCGGAT; SEQ ID NO: 223) and the primer DEco yeeA-CR (ATAGCTGC-CGCAGATGACAATGCTTTTATC; SEQ ID NO: 224) to select a recombinant strain carrying yeeA::Cm. The selected strain was named MG1655 ΔyeeA::Cm.

MG1655 ΔynfM::Cm was produced by the λ-Red method. A PCR reaction was performed using the primer DEco ynfM-Fw (CTACCCTATGTATAAGCCTGATCTA-CAGGCATATTAGCAAGGATTTCAATGA AGCCT-GCTTTTTTATACTAAGTTGGCA; SEQ ID NO: 225) and the primer DEco ynfM-Rv (GAGCTGGCAATAAGTCCG-GACGGGTATTTACCGCAGTCCGGACTTATTTTCG CTCAAGTTAGTATAAAAAAGCTGAACGA; SEQ ID NO: 226) (each containing a partial sequence of the ynfM gene and either the attL sequence or the attR sequence) and pMW118-attL-Cm-attR as a template. The obtained DNA fragment was digested with DpnI restriction enzyme and introduced by electroporation to the MG1655 strain containing the plasmid pKD46, which has an ability to replicate in a thermo-sensitive manner. Cm-resistant recombinants were selected by culturing at 30° C. on LB-agar medium containing 50 mg/L of Amp and 20 mg/L of Cm. A colony PCR was performed using the primer DEco ynfM-CF (AACATCTTATTTGAGATTATTAATATATTA; SEQ ID NO: 227) and the primer DEco ynfM-CR (GGAATTG-GCTGGCGCTTCGTCTATTTTAGG; SEQ ID NO: 228) to select a recombinant strain carrying ynfM::Cm. The selected strain was named MG1655 ΔynJM::Cm.

P1 transduction was performed using MG1655 ΔyeeA::Cm as a donor and the E7-39 strain as a recipient to obtain E7-39 ΔyeeA::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the E-39 ΔyeeA strain.

P1 transduction was performed using MG1655 ΔynJM::Cm as a donor and the E7-39 strain as a recipient to obtain E7-39 ΔynJM::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the E-39 ΔynfM strain.

P1 transduction was performed using MG1655 ΔynJM::Cm as a donor and the E7-39 ΔyeeA strain as a recipient to obtain E7-39 ΔyeeA ΔynJM::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the E-39 ΔyeeA ΔynfM strain.

P1 transduction was performed using the BW25113 yjjP::Kmr strain [rrnB3 ΔlacZ4787 hsdR514 Δ(araBAD)567 Δ(rhaBAD)568 rph-1 yjjP::Kmr] in the Keio collection as a donor and E7-39 as a recipient to obtain E7-39 ΔyjjP::Kmr. Then, a plasmid carrying a FLP recombinase gene, pMAN-FLP, was introduced to this strain to delete the Kmr gene with a method described in Datsenko (Proc. Natl. Acad. Sci. USA, 2000, vol. 97, No. 12, p 6640-6645) and obtain E7-39 ΔyjjP.

P1 transduction was performed using the BW25113 yjjB::Kmr strain [rrnB3 ΔlacZ4787 hsdR514 Δ(araBAD)567 Δ(rhaBAD)568 rph-1 yjjB::Kmr] in the Keio collection as a donor and E7-39 as a recipient to obtain E7-39 ΔyjjB::Kmr. Then, a plasmid carrying a FLP recombinase gene, pMAN-FLP, was introduced to this strain to delete the Kmr gene with a method described in Datsenko (Proc. Natl. Acad. Sci. USA, 2000, vol. 97, No. 12, p 6640-6645) and obtain E7-39 ΔyjjB.

P1 transduction was performed using the BW25113 yjjP::Kmr strain [rrnB3 ΔlacZ4787 hsdR514 Δ(araBAD)567 Δ(rhaBAD)568 rph-1 yjjP::Kmr] in the Keio collection as a donor and E7-39 ΔyeeA ΔynfM as a recipient to obtain E7-39 ΔyeeA ΔynfM ΔyjjP::Kmr. Then, a plasmid carrying a FLP recombinase gene, pMAN-FLP, was introduced to this strain to delete the Kmr gene with a method described in Datsenko (Proc. Natl. Acad. Sci. USA, 2000, vol. 97, No. 12, p 6640-6645) and obtain E7-39 ΔyeeA ΔynfM ΔyjjP.

P1 transduction was performed using the BW25113 yjjB::Kmr strain [rrnB3 ΔlacZ4787 hsdR514 Δ(araBAD)567 Δ(rhaBAD)568 rph-1 yjjB::Kmr] in the Keio collection as a donor and E7-39 ΔyeeA ΔynfM as a recipient to obtain E7-39 ΔyeeA ΔynfM ΔyjjB::Kmr. Then, a plasmid carrying a FLP recombinase gene, pMAN-FLP, was introduced to this strain to delete the Kmr gene with a method described in Datsenko (Proc. Natl. Acad. Sci. USA, 2000, vol. 97, No. 12, p 6640-6645) and obtain E7-39 ΔyeeA ΔynfM ΔyjjB.

<1-5> Construction of the RSFPPG plasmid

RSFPPG (WO 2010027022 A1) is a plasmid obtained by replacing the gltA gene on RSFCPG (see EP0952221) with the prpC gene. RSFPPG was prepared by the following procedures.

The primers RSFBgl-2 (ggaagatctatttgccttcgcacatcaacctgg; SEQ ID NO: 209) and RSFKpn (cggggtaccttgtaaatalll-laacccgcc; SEQ ID NO: 210) were designed to amplify the entire part of RSFCPG except for the ORF of the gltA gene. A PCR was performed using these primers and RSFCPG as a template to obtain a fragment of about 14.9 kb. Separately, for prpC, a PCR was performed using the primers coliprp-CBgl-1 (ggaagatctaaggagaccttaaatgagcgacacaacgatcctg-caaaacagtaccc; SEQ ID NO: 211) and coliprpCKpn (cgggg-tacctcgtagaggtttactggcgcttatccagcg; SEQ ID NO: 212) and the genomic DNA of the $E.\ coli$ strain W3110 as a template to obtain a fragment of about 1.2 kb. Both the PCR products were independently treated with BglII and KpnI and ligated to each other, and then used for transformation of the $E.\ coli$ strain JM109. All of the formed colonies were collected and plasmids were extracted as a mixture. The ME8330 strain, which is deficient in gltA gene encoding a citrate synthase, was transformed with this plasmid mixture and applied onto an M9 minimal medium containing 50 mg/L of uracil and 5 mg/L of thiamine-HCl. All of the formed colonies were collected and plasmids were extracted as a mixture and the $P.\ ananatis$ Glu-producing host bacterial strain NP106 was transformed with this plasmid mixture. A strain showing a yield comparable to that of the $P.\ ananatis$ strain G106 (AJ13601; FERM BP-7207) was named NA1. Furthermore, a plasmid was extracted from this bacterial strain and this plasmid is named RSFPPG, a plasmid for expression of the prpC, gdh, and ppc genes.

<1-6> Cloning of the α-Ketoglutarate Synthase Gene, the Pyruvate Synthase Gene, and the Ferredoxin Gene A plasmid for expressing in $E.\ coli$ the α-ketoglutarate synthase (KGS) gene, the pyruvate synthase (PS) gene, and the ferredoxin (Fd) gene derived from $Chlorobaculum\ tepidum$ was constructed. Experimental procedures will be shown below.

First, a PCR was performed according to an ordinary method and using the genomic DNA of $Chlorobaculum\ tepidum$ as a template and primers as shown in SEQ ID NO: 189 and SEQ ID NO: 190 to amplify the Fd gene. Moreover, the KGS gene was amplified in a similar way using SEQ ID NO: 191 and SEQ ID NO: 192 as primers. A PCR was performed using a mixture of the obtained Fd and KGS gene products as a template and SEQ ID NO: 189 and SEQ ID NO: 192 as primers to obtain a Fd-KGS gene fragment in which both of the fragments were linked together. The purified Fd-KGS gene fragment and a fragment of pMW219-Ptac-Ttrp (WO2013/069634), which had been treated with SmaI restriction enzyme and subsequently purified, were linked together by using the In-Fusion HD Cloning Kit (manufactured by Clontech Laboratories, Inc.). The plasmid for expression of Fd-KGS genes was named pMW219-Fd-KGS.

Next, a PCR was performed according to an ordinary method and using the genomic DNA of $Chlorobaculum\ tepidum$ as a template and primers as shown in SEQ ID NO: 193 and SEQ ID NO: 194 to amplify the PS gene. Moreover, a PCR was performed according to an ordinary method and using the pMW219-Fd-KGS plasmid as a template and primers as shown in SEQ ID NO: 195 and SEQ ID NO: 196 to amplify the pMW219-Fd-KGS fragment. The obtained two fragments were linked together by using the In-Fusion HD Cloning Kit (manufactured by Clontech Laboratories, Inc.). The obtained plasmid for expression of the Fd, KGS, and PS genes was named pMW219-Fd-KGS-PS (also referred to as pMW219-FdKGSPS).

<1-7> Confirmation of Glutamate Production in Anaerobic Culture

Strains are produced by simultaneously introducing the RSFPPG plasmid and the pMW219-FdKGSPS plasmid to each of the strains E3-39, E3-39 ΔyjjP, E3-39 ΔyjjB, E3-39 ΔyeeA, E3-39 ΔynfM, E3-39 ΔyeeA ΔynfMA, E3-39 ΔyeeA ΔynfM ΔyjjP, and E3-39 ΔyeeA ΔynfM ΔyjjB.

Next, the L-glutamate production culture is performed by using the produced bacterial strains to examine the ability to produce L-glutamic acid. The bacterial strains are uniformly applied onto LBM9Glc plates (produced by adding 200 mL of 5×M9 salts and 10 mL of 50% glucose to 800 mL of LB medium) containing a suitable antibiotic (50 μg/mL of kanamycin or 15 μg/mL of tetracycline) and cultured at 37° C. for 16-20 hours. Then, those plates are placed into an AnaeroPack pouch (manufactured by Mitsubishi Gas Chemical Company, Inc.; for easy cultivation of anaerobic bacteria; Product Number: A-04) and incubated under anaerobic conditions at 37° C. for 6 hours. Obtained bacterial cells on the plates are suspended in 700 μL of 0.8% saline to give an optical density (OD) of 0.5 to 1.5 (600 nm) when diluted 51 times. To a screw cap microtube having a volume of 1.5 mL, 200 μl of this bacterial cell suspension and 1 mL of the production medium purged with a sufficient amount of carbon dioxide gas in advance (1 vvm, 30 minutes or longer) are placed and covered tightly with the cap and then incubated using a microtube shaker under anaerobic conditions at 37° C. for 24 or 48 hours. The composition of the production medium is shown below.

The composition of the production medium

| Part A: | |
|---|---|
| Glucose | 10 g/L (final concentration) |
| Part B: | |
| Magnesium sulfate heptahydrate | 1 g/L |
| Ammonium sulfate | 15 g/L |
| Monopotassium phosphate | 1 g/L |
| Biotin | 1 mg/L |
| Vitamin B1 | 1 mg/L |
| Trace metal solution | 10 mL/L |
| (adjusted to pH = 7 with KOH) | |
| Part C: | |
| Calcium carbonate (Japanese Pharmacopeia) | 50 g/L |

After Part A and Part B are separately sterilized by autoclaving at 115° C. for 10 minutes and Part C is sterilized by dry-heating at 180° C. for 3 hours, they are left to cool and then mixed.

The trace metal solution is a solution containing, per liter, 1.35 g of $FeCl_2.6H_2O$, 680 mg of $ZnCl_2$, 249 mg of CuSO$_4$.5H$_2$O, 120 mg of MnSO$_4$.5H$_2$O, 118 mg of CoCl$_2$.6H$_2$O, and 123 mg of (NH$_4$)6Mo$_7$O$_{24}$.4H$_2$O.

After the culture, the concentrations of glutamic acid accumulated and the sugar remaining in the medium are analyzed with the Biotech Analyzer AS-310 (Sakura SI Co. Ltd.). Moreover, the amounts of other organic acids are analyzed with a liquid chromatography HPLC system (L-7100, L-7200, L-7300, or L-7400; Hitachi High-Technologies Co.) and the URUTRON PS-80H column (Shinwa Chemical Industries Ltd.). The turbidity (OD) of the bacterial cell suspension is measured using the Spectrophotometer DU800 (Beckman Coulter) after calcium carbonate in the medium is dissolved by diluting the sample with 0.1 N hydrochloric acid.

Example 2: Effects of Dicarboxylic Acid Exporter Protein Deficiency in Glutamate Production by *E. aerogenes*

In this Example, dicarboxylic acid exporter gene-deficient strains derived from *Enterobacter aerogenes* AJ110637 (FERM BP-10955) were constructed to produce glutamic acid. AJ110637 (FERM BP-10955) has been deposited in International Patent Organism Depositary, National Institute of Advanced Industrial Science and Technology (currently, International Patent Organism Depositary, National Institute of Technology and Evaluation; address: #120, 2-5-8, Kazusakamatari, Kisarazu-shi, Chiba 292-0818 Japan) on Aug. 22, 2007 and has been assigned the accession number FERM BP-10955.

<2-1> Construction of the ES06 Strain

The *Enterobacter aerogenes* ES06 strain was constructed by replacing the poxB gene on the genome of the ES04 strain (US2010-0297716A1), which had been constructed from the *Enterobacter aerogenes* strain AJ110637 (FERM BP-10955), with the pckA gene from the *Actinobacillus succinogenes* strain 130Z. Experimental procedures will be shown below.

Construction of the λattL-Km$^r$-λattR-Ptac-pckA Gene Fragment

The entire nucleotide sequence of the genomic DNA of the *Actinobacillus succinogenes* strain 130Z (ATCC 55618) has already been released (GenBank Accession No. CP000746) and a gene encoding a phosphoenolpyruvate carboxykinase (gene name: pckA; accession number: Asuc_0221) has been identified. The nucleotide sequence of the pckA gene from the *Actinobacillus succinogenes* strain 130Z is shown in SEQ ID NO: 213 and the amino acid sequence of a phosphoenolpyruvate carboxykinase encoded by the same gene is shown in SEQ ID NO: 214. A PCR reaction (TaKaRa Prime star (registered trademark); 30 cycles of 94° C. for 10 sec., 54° C. for 20 sec., and 72° C. for 90 sec.) was performed using the genomic DNA of the *Actinobacillus succinogenes* strain 130Z as a template and primers designed based on the above-described nucleotide sequence and listed as SEQ ID NO: 215 and SEQ ID NO: 216 to obtain a DNA fragment containing the pckA ORF region. Moreover, a PCR reaction (TaKaRa Prime star (registered trademark); 30 cycles of 94° C. for 10 sec., 54° C. for 20 sec., and 72° C. for 90 sec.) was performed using a DNA fragment containing λattL-Km$^r$-λattR-Ptac (WO2008090770A1) as a template and primers listed as SEQ ID NO: 217 and SEQ ID NO: 218 to obtain a DNA fragment containing λattL-Km$^r$-λattR-Ptac. Then, a PCR reaction (TaKaRa Prime star (registered trademark); 35 cycles of 94° C. for 10 sec., 54° C. for 20 sec., and 72° C. for 180 sec.) was performed using the DNA fragment containing the pckA ORF region and the DNA fragment containing λattL-Km$^r$-λattR-Ptac as templates and primers listed as SEQ ID NO: 216 and SEQ ID NO: 217 to obtain the λattL-Km$^r$-λattR-Ptac-pckA gene fragment having sequences for recombination with a gene encoding a pyruvate oxidase (gene name: poxB) at the respective ends.

Construction of the ES04/RSFRedTER Strain

The ES04 strain (US20100297716A1) was cultured overnight in liquid LB medium. Then, 100 μL of the culture broth was inoculated into 4 mL of fresh liquid LB medium and incubated with shaking at 34° C. for 3 hours. After bacterial cells were collected, they were washed three times with 10% glycerol to make competent cells and introduced with RSFRedTER (WO2008/090770A1) by electroporation. The electroporation was carried out by using the GENE PULSER II (manufactured by Bio-Rad Laboratories, Inc.) under the following conditions: electric field intensity, 20 kV/cm; capacitance, 25 μf; electric resistance, 200Ω. After two hours of culture in SOC medium (BACTO Tryptone, 20 g/L; yeast extract, 5 g/L; NaCl, 0.5 g/L; glucose, 10 g/L), the culture broth was applied onto LB medium containing 40 mg/L of chloramphenicol and incubated for 16 hours. Eventually, a transformant exhibiting chloramphenicol resistance was obtained and named ES04/RSFRedTER strain.

Construction of the ES04 ΔpoxB::λattL-Km$^r$-λattR-Ptac-pckA Strain

The ES04/RSFRedTER strain was cultured overnight in liquid LB medium. Then, 1 mL of the culture broth was inoculated into 100 mL of liquid LB medium containing final concentrations of 1 mM IPTG and 40 mg/L chloramphenicol and incubated with shaking at 34° C. for 3 hours. After bacterial cells were collected, they were washed three times with 10% glycerol to make competent cells. The amplified λattL-Km$^r$-λattR-Ptac-pckA gene fragment was purified using the Wizard PCR Prep DNA Purification System (manufactured by Promega Co.) and introduced to the competent cells by electroporation. After two hours of culture in SOC medium, the culture broth was applied onto LB medium containing 50 mg/L of kanamycin and incubated for 16 hours. After purifying the formed colonies with the same medium, a colony PCR (TaKaRa Speed star (registered trademark); 40 cycles of 92° C. for 10 sec., 56° C. for 10 sec., and 72° C. for 30 sec.) was performed using primers listed as SEQ ID NO: 219 and SEQ ID NO: 220 to confirm that the poxB gene on the genome was replaced with the λattL-Km$^r$-λattR-Ptac-pckA gene. The obtained strain was applied onto LB-agar medium containing 10% sucrose and 1 mM IPTG to remove the RSFRedTER plasmid and eventually obtain the ES04 ΔpoxB::λattL-Km$^r$-λattR-Ptac-pckA strain.

Removal of the Kanamycin-Resistance Gene from the ES04 ΔpoxB::λattL-Km$^r$-λattR-Ptac-pckA Strain The RSF-int-xis plasmid (US20100297716A1) was used to remove the kanamycin-resistance gene from the ES04 ΔpoxB::λattL-Km$^r$-λattR-Ptac-pckA strain. The ES04 ΔpoxB::λattL-Km$^r$-λattR-Ptac-pckA strain was introduced with RSF-int-xis by electroporation, applied onto LB medium containing 40 mg/L of chloramphenicol, and cultured at 30° C. to obtain the ES04 ΔpoxB::λattL-Km$^r$-λattR-Ptac-pckA/RSF-int-xis strain. The obtained plasmid-carrying strain was purified with LB medium containing 40 mg/L chloramphenicol and 1 mM IPTG to obtain plural single colonies. Then, the colonies were applied onto a medium supplemented with 50 mg/L kanamycin and cultured overnight at 37° C. to confirm by identifying the inability of the colonies to grow that they were from a strain in which the kanamycin-resistance gene had been removed. Then, to remove the RSF-int-xis plasmid from the obtained strain, the strain was applied onto LB medium supplemented with 10% sucrose and 1 mM IPTG and cultured overnight at 37° C. Among formed colonies, a strain exhibiting chloramphenicol sensitivity was named ES06 strain.

<2-2> Construction of the RSFPP Plasmid

The RSFPP plasmid was obtained by deleting a region containing the gdhA gene from RSFPPG (WO 2010027022 A1). Specifically, the RSFPPG plasmid was treated with NspV restriction enzyme and treated by heating at 75° C. for 10 minutes to inactivate the enzyme and subsequently self-ligated using a DNA ligation kit manufactured by Takara Bio Inc. The E. coli strain DH5α was transformed with this DNA solution and selected on LB-agar medium containing 12.5 mg/L of tetracycline to obtain the DH5α/RSFPP strain.

<2-3> Construction of the ES06 ΔyeeA Strain

The ES06 ΔyeeA strain was produced by the λ-red method. Specifically, a PCR reaction was performed using primers as shown in SEQ ID NOs: 197 and 198 and pMW118-attL-Kmr-attR (WO2008/090770A1) as a template to amplify a fragment having sequences of 50 bp complementary to the internal sequence of the yeeA gene in Enterobacter aerogenes at the respective ends and containing the kanamycin-resistance gene flanked by the attL and attR sequences of λ phage. The ES06 strain carrying RSFRedTER (BMC Mol. Biol. 10, 34 (2009)) was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μF; electric resistance, 200Ω. The ES06 ΔyeeA::Km strain was obtained by selection on LB-agar medium containing 40 mg/L of kanamycin. The obtained strain was applied onto LB-agar medium containing M9 components (17.1 g/L Na$_2$HPO$_4$.12H$_2$O, 3 g/L KH$_2$PO$_4$, 0.5 g/L NaCl, 1 g/L NH$_4$Cl), 10% sucrose, and 1 mM IPTG to obtain a strain which had lost the RSFRedTER plasmid. This strain was introduced with the pMW-intxis-sacB plasmid (identical to pMW-intxis-sacB (Cm) plasmid disclosed in WO2015/005405) by electroporation and selected on LB-agar medium containing 25 mg/L of chloramphenicol to obtain the ES06 ΔyeeA::Km/pMW-intxis-sacB strain. After purifying this strain on LB-agar medium, a replica was prepared with LB-agar medium containing 40 mg/L of kanamycin to identify a kanamycin-sensitive strain: the ES06 ΔyeeA strain.

<2-4> Construction of the ES06 ΔyeeA ΔynfM Strain

The ES06 ΔyeeA ΔynfM strain was produced from the ES06 ΔyeeA strain by the above-described λ-red method. Specifically, a PCR reaction was performed using primers as shown in SEQ ID NOs: 199 and 200 and pMW118-attL-Kmr-attR as a template to amplify a fragment having sequences of 50 bp complementary to the internal sequence of the ynfM gene in Enterobacter aerogenes at the respective ends and containing the kanamycin-resistance gene flanked by the attL and attR sequences of λ phage. The ES06 ΔyeeA/RSFRedTER strain, which had been obtained by introducing RSFRedTER into the ES06 ΔyeeA strain by electroporation, was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μf; electric resistance, 200Ω. The ES06 ΔyeeA ΔynfM::Km strain was obtained by selection on LB-agar medium containing 40 mg/L of kanamycin. The obtained strain was applied onto LB-agar medium containing M9 components (17.1 g/L Na$_2$HPO$_4$.12H$_2$O, 3 g/L KH$_2$PO$_4$, 0.5 g/L NaCl, 1 g/L NH$_4$Cl), 10% sucrose, and 1 mM IPTG to obtain a strain which had lost the RSFRedTER plasmid. This strain was introduced with the pMW-intxis-sacB plasmid by electroporation and selected on LB-agar medium containing 25 mg/L of chloramphenicol to obtain the ES06 ΔyeeA ΔynfM::Km/pMW-intxis-sacB strain. After purifying this strain on LB-agar medium, a replica was prepared with LB-agar medium containing 40 mg/L of kanamycin to identify a kanamycin-sensitive strain: the ES06 ΔyeeA ΔynfM strain.

<2-5> Construction of the sdhA-Disrupted Strain

The ES06 ΔsdhA strain, which is deficient in the sdhA gene encoding a subunit of a succinate dehydrogenase, was produced from the ES06 strain by the above-described λ-red method. Specifically, a PCR reaction was performed using primers as shown in SEQ ID NOs: 201 and 202 and pMW118-attL-Kmr-attR as a template to amplify a fragment having sequences of 50 bp complementary to the internal sequence of the sdhA gene in Enterobacter aerogenes at the respective ends and containing the kanamycin-resistance gene flanked by the attL and attR sequences of λ phage. The ES06 strain carrying RSFRedTER was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μf; electric resistance, 200Ω. The ES06 ΔsdhA::Km strain was obtained by selection on LB-agar medium containing 40 mg/L kanamycin and 20 mM disodium malate. The obtained strain was applied onto LB-agar medium containing M9 components (17.1 g/L Na$_2$HPO$_4$.12H$_2$O, 3 g/L KH$_2$PO$_4$, 0.5 g/L NaCl, 1 g/L NH$_4$Cl), 10% sucrose, and 1 mM IPTG to obtain a strain which had lost the RSFRedTER plasmid. This strain was introduced with the pMW-intxis-sacB plasmid by electroporation and selected on LB-agar medium containing 25 mg/L chloramphenicol and 20 mM disodium malate to obtain the ES06 ΔsdhA::Km/pMW-intxis-sacB strain. After purifying this strain on LB-agar medium containing 20 mM disodium malate, a replica was prepared with LB-agar medium containing 40 mg/L kanamycin and 20 mM disodium malate to identify a kanamycin-sensitive strain: the ES06 ΔsdhA strain. Moreover, strains deficient in the sdhA gene were derived similarly from the ES06 ΔyeeA strain and the ES06 ΔyeeA ΔynfM strain and named ES06 ΔsdhA ΔyeeA strain and ES06 ΔsdhA ΔyeeA ΔynfM strain, respectively. These strains were introduced with the RSFPP plasmid by electroporation and selected on LB-agar medium containing 12.5 mg/L tetracycline and 20 mM disodium malate to identify the respective strains: the ES06 ΔsdhA/RSFPP strain, the ES06 ΔsdhA ΔyeeA/RSFPP strain, and the ES06 ΔsdhA ΔyeeA ΔynfM/RSFPP strain.

<2-6> Glutamate Production

Next, the ability to produce glutamic acid was evaluated in these strains. The composition of the production medium is shown below.

The composition of the production medium

| Part A: | |
|---|---|
| Sucrose | 30 g/L |
| MgSO$_4$•7H$_2$O | 0.5 g/L |
| Part B: | |
| (NH$_4$)$_2$SO$_4$ | 2.0 g/L |
| KH$_2$PO$_4$ | 2.0 g/L |
| Yeast Extract | 2.0 g/L |
| FeSO$_4$•7H$_2$O | 0.02 g/L |
| MnSO$_4$•5H$_2$O | 0.02 g/L |
| L-lysine hydrochloride | 0.2 g/L |
| DL-methionine | 0.2 g/L |
| Diaminopimelic acid | 0.2 g/L |
| (adjusted to pH 7.0 with KOH) | |
| Part C: | |
| CaCO$_3$ | 20 g/L |

After Part A and Part B were separately sterilized by autoclaving at 115° C. for 10 minutes and Part C is sterilized by dry-heating at 180° C. for 3 hours, they were mixed and tetracycline hydrochloride was added thereto to 12.5 mg/L.

The ES06 ΔsdhA/RSFPP strain, the ES06 ΔsdhA ΔyeeA/RSFPP strain, and the ES06 ΔsdhA ΔyeeA ΔynfM/RSFPP strain were cultured overnight at 34° C. on LBGM9 medium plates containing 12.5 mg/L of tetracycline and 15 g/L of agar, and then an appropriate amount of the obtained bacterial cells of each strain was inoculated into a test tube containing 5 mL of the above-described medium and incubated at 34° C. with shaking at 120 rpm.

The results are shown in Table 1. The ability to produce L-glutamic acid was increased in the ES06 ΔsdhA ΔyeeA/RSFPP strain deficient in the yeeA gene and in the ES06 ΔsdhA ΔyeeA ΔynfM/RSFPP strain further deficient in the ynfM gene as compared with the control ES06 ΔsdhA/RSFPP strain. From the above results, it was revealed that the ability to produce glutamic acid is increased by deleting dicarboxylic acid exporter gene(s) in *Enterobacter aerogenes*.

TABLE 1

| | Concentration of accumulated glutamic acid ± S.E. (g/L) | Yield of glutamic acid ± S.E. (%) |
|---|---|---|
| ES-06 ΔsdhA/RSFPP | 0.9 ± 0.0 | 2.6 ± 0.1 |
| ES-06 ΔsdhA ΔyeeA/RSFPP | 2.4 ± 0.1 | 10.0 ± 1.2 |

TABLE 1-continued

| | Concentration of accumulated glutamic acid ± S.E. (g/L) | Yield of glutamic acid ± S.E. (%) |
|---|---|---|
| ES-06 ΔsdhA ΔyeeA ΔynfM/RSFPP | 3.0 ± 0.1 | 17.0 ± 0.4 |

Example 3: Effects of Dicarboxylic Acid Exporter Protein Deficiency in Glutamate Production by *P. ananatis*

In this Example, dicarboxylic acid exporter gene-deficient strains derived from the *P. ananatis* strain SC17(0) (VKPM B-9246) were constructed to produce glutamic acid. The SC17(0) strain has been deposited in Russian National Collection of Industrial Microorganisms (VKPM), GNII Genetika (address: 1-st Dorozhny proezd, 1, 117545 Moscow, Russia) on Sep. 21, 2005 under the accession number VKPM B-9246.

<3-1> Construction of the *P. ananatis* yeeA Gene-Deficient Strain

A PCR reaction was performed using primers as shown in SEQ ID NOs: 203 and 204 and pMW118-attL-Kmr-attR as a template to amplify a fragment having sequences of 50 bp complementary to the internal sequence of the yeeA gene in *Pantoea ananatis* at the respective ends and containing the kanamycin-resistance gene flanked by the attL and attR sequences of λ phage. The SC17(0) strain carrying RSFRedTER (BMC Molecular Biology 2009, 10:34) was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μF; electric resistance, 200Ω. The SC17(0) ΔyeeA::Km strain was obtained by selection on LB-agar medium containing 40 mg/L of kanamycin.

<3-2> Construction of the *P. ananatis* ynfM Gene-Deficient Strain

A PCR reaction was performed using primers as shown in SEQ ID NOs: 205 and 206 and pMW118-attL-Tetr-attR (identical to pMW118-attL-Tc-attR plasmid disclosed in WO2005/010175) as a template to amplify a fragment having sequences of 50 bp complementary to the internal sequence of the ynfM gene in *Pantoea ananatis* at the respective ends and containing the tetracycline-resistance gene flanked by the attL and attR sequences of λ phage. The SC17(0) strain carrying RSFRedTER was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μF; electric resistance, 200Ω. The SC17(0) ΔynfM::Tet strain was obtained by selection on LB-agar medium containing 12.5 mg/L of tetracycline.

<3-3> Construction of the *P. ananatis* sdhA-Deficient Strain

A PCR reaction was performed using primers as shown in SEQ ID NOs: 207 and 208 and pMW118-attL-Kmr-attR as a template to amplify a fragment having sequences of 50 bp complementary to the internal sequence of the sdhA gene in *Pantoea ananatis* at the respective ends and containing the kanamycin-resistance gene flanked by the attL and attR sequences of λ phage. The SC17(0) strain carrying RSFRedTER was cultured overnight in liquid LB medium, and 1 mL of the culture broth was inoculated into 100 mL of liquid LB medium containing final concentrations of 1 mM IPTG and 25 mg/L chloramphenicol and incubated with shaking at 34° C. for 3 hours. After bacterial cells were collected, they were washed three times with 10% glycerol to make competent cells. The amplified PCR fragment was purified using the Wizard PCR Prep manufactured by Promega Corporation and introduced to the competent cells by electroporation. The electroporation was carried out by using the GENE PULSER II (manufactured by Bio-Rad Laboratories, Inc.) under the following conditions: electric field intensity, 20 kV/cm; capacitance, 25 μF; electric resistance, 200Ω. The SC17(0) ΔsdhA::Km strain was obtained by selection on LB-agar medium containing 40 mg/L kanamycin and 20 mM disodium malate. The obtained strain was applied onto LB-agar medium containing M9 components (17.1 g/L Na$_2$HPO$_4$·12H$_2$O, 3 g/L KH$_2$PO$_4$, 0.5 g/L NaCl, 1 g/L NH$_4$Cl), 10% sucrose, and 1 mM IPTG to obtain a strain which had lost the RSFRedTER plasmid. This strain was transfected with the pMW-intxis-sacB plasmid by electroporation and selected on LB-agar medium containing 25 mg/L chloramphenicol and 20 mM disodium malate to obtain the SC17(0) ΔsdhA::Km/pMW-intxis-sacB strain. After purifying this strain on LB-agar medium containing 20 mM disodium malate, a replica was prepared with LB-agar medium containing 40 mg/L kanamycin and 20 mM disodium malate to identify a kanamycin-sensitive strain: the SC17(0) ΔsdhA strain.

<3-4> Construction of Strains Deficient in the yeeA Gene and the ynfM Gene from the SC17(0) ΔsdhA Strain The genomic DNA was extracted from each of the SC17 (0) ΔyeeA::Km strain and the SC17(0) ΔynfM::Tet strain by using the Bacterial Genomic DNA Purification Kit manufactured by Edge Biosystems Inc. Separately, the SC17(0) ΔsdhA strain was cultured overnight on LBGM9-agar medium (LB medium containing 17.1 g/L Na$_2$HPO$_4$·12H$_2$O, 3 g/L KH$_2$PO$_4$, 0.5 g/L NaCl, 1 g/L NH$_4$Cl, 5 g/L glucose, 15 g/L agar). Bacterial cells were scraped using a cell scraper, washed three times with ice-cold 10% glycerol, and suspended with 10% glycerol to a final volume of 500 μL to thereby prepare competent cells. To these competent cells, 600 ng of the genomic DNA from the SC17(0) ΔyeeA::Km strain was introduced using the GENE PULSER II (manufactured by Bio-Rad Laboratories, Inc.) under the following conditions: electric field intensity, 20 kV/cm; capacitance, 25 μf; electric resistance, 200Ω. After adding ice-cold SOC medium to the cell suspension and incubating with shaking at 34° C. for 2 hours, transformants were selected at 34° C. on LBGM9-agar medium containing 40 mg/L of kanamycin. The obtained strain was named SC17(0) ΔsdhA ΔyeeA::Km strain. Similarly, the genomic DNA of the SC17(0) ΔynfM:: Tet strain was introduced to the host SC17(0) ΔsdhA ΔyeeA::Km strain and the SC17(0) ΔsdhA ΔyeeA::Km ΔynfM::Tet strain was obtained by selection on LBGM9-agar medium containing 12.5 mg/L of tetracycline and 40 mg/L of kanamycin. These strains were introduced with the pMW-intxis-sacB plasmid by electroporation and selected on LBGM9-agar medium containing 25 mg/L of chloramphenicol to obtain the SC17(0) ΔsdhA ΔyeeA::Km/pMW-intxis-sacB strain and the SC17(0) ΔsdhA ΔyeeA::Km ΔynfM::Tet/pMW-intxis-sacB strain. After purifying the strains on LBGM9-agar medium, replicas were prepared with LBGM9-agar medium containing 40 mg/L of kanamycin or 12.5 mg/L of tetracycline to identify a strain sensitive to kanamycin and a strain sensitive to tetracycline: the SC17(0) ΔsdhA ΔyeeA strain and the SC17(0) ΔsdhA ΔyeeA ΔynfM strain. Competent cells were prepared from the SC17(0) ΔsdhA strain and these strains and introduced with the RSFCPG plasmid by electroporation, and transformants were selected on LBGM9-agar medium containing 12.5 mg/L of tetracycline to obtain the SC17(0) ΔsdhA/RSFCPG strain, the SC17(0) ΔsdhA ΔyeeA/RSFCPG strain, and the SC17(0) ΔsdhA ΔyeeA ΔynfM/RSFCPG strain.

<3-5> Glutamate Production

Next, the ability to produce glutamic acid was evaluated in these strains. The composition of the production medium is shown below.

The Composition of the Production Medium

| Part A: | |
|---|---|
| Sucrose | 100 g/L |
| MgSO$_4$•7H$_2$O | 0.5 g/L |
| Part B: | |
| (NH$_4$)$_2$SO$_4$ | 5.0 g/L |
| KH$_2$PO$_4$ | 6.0 g/L |
| Yeast Extract | 6.0 g/L |
| FeSO$_4$•7H$_2$O | 0.02 g/L |
| MnSO$_4$•5H$_2$O | 0.02 g/L |
| GD113 | 0.1 mL/L |
| (adjusted to pH 7.0 with KOH) | |

After Part A and Part B were separately sterilized by autoclaving at 120° C. for 20 minutes, they were mixed and tetracycline hydrochloride was added thereto to 12.5 mg/L.

The SC17(0) ΔsdhA/RSFCPG strain, the SC17(0) ΔsdhA ΔyeeA/RSFCPG strain, and the SC17(0) ΔsdhA ΔyeeA ΔynJM/RSFCPG strain were each cultured overnight at 34° C. on LBGM9-agar medium containing 12.5 mg/L of tetracycline. Bacterial cells on one plate were inoculated into a jar fermenter containing 250 mL of the above-described medium and cultured at 34° C. with stirring at 900 rpm while adjusting pH to 6.0 with ammonia.

Figure 2:
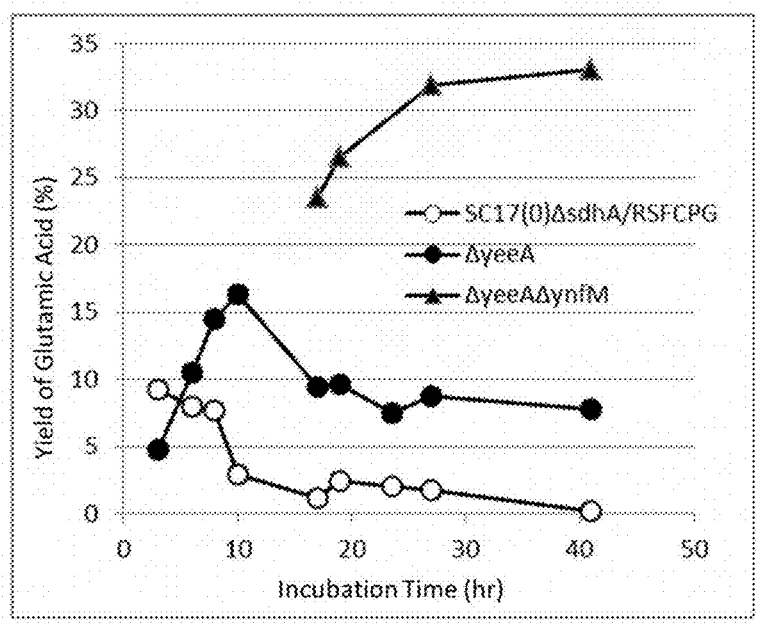
FIG. 2 indicates the effect of reduced activities of dicarboxylic acid exporter proteins on the yield of L-glutamic acid.

The results are shown in FIG. 1 and FIG. 2. As compared with the control SC17(0) ΔsdhA/RSFCPG strain, an increased ability to produce L-glutamic acid was observed in the SC17(0) ΔsdhA ΔyeeA/RSFCPG strain deficient in the yeeA gene (FIG. 1), and the yield of L-glutamic acid was significantly increased in the SC17(0) ΔsdhA ΔyeeA ΔynfM/ RSFCPG strain further deficient in the ynfM gene (FIG. 2). From the above results, it was revealed that the ability to produce glutamic acid is increased by deleting dicarboxylic acid exporter gene(s) also in *P. ananatis*.

Example 4: Effects of Dicarboxylic Acid Exporter Protein Deficiency in Glutamate Production by *Brevibacterium lactofermentum* (1)

In this Example, dicarboxylic acid exporter gene-deficient strains derived from *Brevibacterium lactofermentum*

(*Corynebacterium glutamicum*) 2256 (ATCC 13869) were constructed to produce glutamic acid.

<4-1> Construction of the *Brevibacterium* Lactofermentum 2256 ΔLdh Δpta-ack ΔpoxB Δach, yggBL30 Strain (FKS0121 Strain)

The L30-type mutation was introduced into the yggB gene on the genome of the *B. lactofermentum* 2256 Δ(ldh, pta-ack, poxB, ach) strain (WO2005/113745) by the following procedures to construct the FKS0121 strain having an increased ability to produce glutamic acid.

The pBS4YggB-L plasmid carrying the yggB gene having the L30-type mutation (Japanese Patent Application Publication No. 2007/97573) was introduced to the 2256 Δ(ldh, pta-ack, poxB, ach) strain by the electrical pulse method. The bacterial cells were applied onto CM-Dex-agar medium containing 25 μg/mL of kanamycin and cultured at 31.5° C. A grown strain was verified by PCR to be a single-recombination strain in which pBS4yggB-L had been integrated on the genome by homologous recombination. The single-recombination strain has both the wild-type yggB gene and the mutant yggB gene.

The single-recombination strain was cultured overnight in liquid CM-Dex medium, and the culture broth was applied onto S10-agar medium (sucrose, 100 g/L; polypeptone, 10 g/L; yeast extract, 10 g/L; $KH_2PO_4$, 1 g/L; $MgSO_4.7H_2O$, 0.4 g/L; $FeSO_4.7H_2O$, 0.01 g/L; $MnSO_4.4-5H_2O$, 0.01 g/L; urea, 3 g/L; soy protein hydrolysate solution, 1.2 g/L; agar, 20 g/L; adjusted to pH 7.5 with NaOH; autoclaved at 120° C. for 20 minutes) and incubated at 31.5° C. Among formed colonies, strains exhibiting kanamycin sensitivity were purified on CM-Dex-agar medium. A PCR was performed using the genomic DNA prepared from each of these strains and synthetic DNA primers as shown in SEQ ID NO: 251 and SEQ ID NO: 252, and then the nucleotide sequence of the amplified fragment was checked to identify a strain carrying the yggB gene introduced with the L30-type mutation. The strain was named FKS0121. The genotype of the strain is 2256 Δldh Δpta-ack ΔpoxB Δach, yggBL30.

<4-2> Construction of Strains Each Deficient in Succinic Acid Exporter Gene Derived from the FKS0121 Strain <4-2-1> Construction of the FKS0121 ΔsucE1 Strain The plasmid pBS4S ΔsucE1 for deletion of the sucE1 gene (WO2007/046389) was introduced to the FKS0121 strain by the electrical pulse method. The bacterial cells were applied onto CM-Dex-agar medium containing 25 μg/mL of kanamycin and cultured at 31.5° C. A grown strain was verified by PCR to be a single-recombination strain in which pBS4S ΔsucE1 had been integrated on the genome by homologous recombination. The single-recombination strain has both the wild-type sucE1 gene and the deletion-type sucE1 gene.

The single-recombination strain was cultured overnight in liquid CM-Dex medium, and the culture broth was applied onto S10-agar medium (sucrose, 100 g/L; polypeptone, 10 g/L; yeast extract, 10 g/L; $KH_2PO_4$, 1 g/L; $MgSO_4.7H_2O$, 0.4 g/L; $FeSO_4.7H_2O$, 0.01 g/L; $MnSO_4.4-5H_2O$, 0.01 g/L; urea, 3 g/L; soy protein hydrolysate solution, 1.2 g/L; agar, 20 g/L; adjusted to pH 7.5 with NaOH; autoclaved at 120° C. for 20 minutes) and incubated at 31.5° C. Among formed colonies, strains exhibiting kanamycin sensitivity were purified on CM-Dex-agar medium. A PCR was performed using the genomic DNA prepared from each of these strains and synthetic DNA primers as shown in SEQ ID NO: 253 and SEQ ID NO: 254 to identify a strain deficient in the sucE1 gene. The strain was named FKS0121 ΔsucE1 strain.

<4-2-2> Construction of the FKS0121 ΔynfM Strain

Construction of the plasmid pBS4S ΔynfM1 for deletion of the ynfM gene

A PCR was performed using the genomic DNA of the *B. lactofermentum* strain 2256 as a template and synthetic DNA primers as shown in SEQ ID NOs: 255 and 256 to obtain a PCR product containing the N-terminal coding region of the ynfM gene. Separately, a PCR was performed using the genomic DNA of the *B. lactofermentum* strain 2256 as a template and synthetic DNA primers as shown in SEQ ID NOs: 257 and 258 to obtain a PCR product containing the C-terminal coding region of the ynfM gene. SEQ ID NOs: 256 and 257 partially have complementary sequences. Next, the PCR products containing the N-terminal coding region of the ynfM gene and the C-terminal coding region of the ynfM gene were mixed in almost equimolar amounts and inserted into the pBS4S vector (WO2007/046389) treated with BamHI and PstI by using the In Fusion HD cloning kit (manufactured by Clontech Laboratories, Inc.). Competent cells of *Escherichia coli* JM109 (Takara Shuzo Co., Ltd.) were transformed with this DNA and applied onto LB medium containing 100 μM IPTG 40 μg/mL X-Gal, and 25 μg/mL Km and cultured overnight. Then, formed white colonies were picked up and subjected to single-colony isolation to obtain transformants. Plasmids were extracted from the obtained transformants to identify a plasmid with the insertion of the PCR product of interest and the plasmid was named pBS4S ΔynfM.

Construction of the FKS0121 ΔynfM Strain

Because the above-obtained pBS4S ΔynfM does not contain a region that allows the plasmid to replicate autonomously in coryneform bacterial cells, in cases where a coryneform bacterium is transformed with this plasmid, though very infrequently, a strain carrying this plasmid integrated on the genome by homologous recombination is formed as a transformant. Thus, the pBS4S ΔynfM1 was introduced to the FKS0121 strain by the electrical pulse method. The bacterial cells were applied onto CM-Dex-agar medium containing 25 μg/mL of kanamycin and cultured at 31.5° C. A grown strain was verified by PCR to be a single-recombination strain in which pBS4S ΔynfM had been integrated on the genome by homologous recombination. The single-recombination strain has both the wild-type ynfM gene and the deletion-type ynfM gene.

The single-recombination strain was cultured overnight in liquid CM-Dex medium, and the culture broth was applied onto S10-agar medium (sucrose, 100 g/L; polypeptone, 10 g/L; yeast extract, 10 g/L; $KH_2PO_4$, 1 g/L; $MgSO_4.7H_2O$, 0.4 g/L; $FeSO_4.7H_2O$, 0.01 g/L; $MnSO_4.4-5H_2O$, 0.01 g/L; urea, 3 g/L; soy protein hydrolysate solution, 1.2 g/L; agar, 20 g/L; adjusted to pH 7.5 with NaOH; autoclaved at 120° C. for 20 minutes) and incubated at 31.5° C. Among formed colonies, strains exhibiting kanamycin sensitivity were purified on CM-Dex-agar medium. A PCR was performed using the genomic DNA prepared from each of these strains and synthetic DNA primers as shown in SEQ ID NO: 255 and SEQ ID NO: 258 to identify a strain deficient in the ynfM gene. The strain was named FKS0121 ΔynfM strain.

<4-3> Construction of the FKS0121/pVK9::PmsrA-pyc Strain, the FKS0121 ΔsucE1/pVK9::PmsrA-pyc Strain, and the FKS0121 ΔynfM/pVK9::PmsrA-pyc Strain <4-3-1> Construction of the Plasmid pVK9::PmsrA-pyc for Expression of the pyc Gene The plasmid pVK9::PmsrA-pyc for expression of the pyc gene derived from *B. lactofermentum* 2256 was produced by the method described below. The pyc gene is a gene encoding a pyruvate carboxylase. The nucleotide sequence of the pyc gene in *B. lactofermentum* 2256 and the amino acid sequence of the protein encoded by the same gene are shown in SEQ ID NOs: 275 and 276, respectively. First, the pyc gene was linked by cross-over PCR to the promoter of the methionine sulfoxide reductase A gene (msrA) derived from *B. lactofermentum* 2256. Specifically, a PCR was performed using the genomic DNA of the *B. lactofermentum* strain 2256 as a template and synthetic DNA primers as shown in SEQ ID NOs: 259 and 260 to obtain a PCR product containing the promoter region of the msrA gene. Separately, a PCR was performed using the genomic DNA of the *B. lactofermentum* strain 2256 as a template and synthetic DNA primers as shown in SEQ ID NOs: 261 and 262 to obtain a PCR product containing the ORF region of the pyc gene. SEQ ID NOs: 260 and 261 have complementary sequences. Next, the PCR products containing the promoter region of the msrA gene and the ORF region of the pyc gene were mixed in almost equimolar amounts and a PCR was performed using synthetic DNA primers as shown in SEQ ID NOs: 263 and 264 to obtain the pyc gene fragment linked to the promoter of the msrA gene. Then, the fragment was inserted into the pVK9 vector (WO2007/046389) treated with BamHI and PstI by using the In Fusion HD cloning kit (manufactured by Clontech Laboratories, Inc.). Incidentally, the pVK9 is a shuttle vector for *Corynebacterium* bacteria and *E. coli*. Competent cells of *Escherichia coli* JM109 (Takara Shuzo Co., Ltd.) were transformed with this DNA and applied onto LB medium containing 100 μM IPTG 40 μg/mL X-Gal, and 25 μg/mL Km and cultured overnight. Then, formed white colonies were picked up and subjected to single-colony isolation to obtain transformants. Plasmids were extracted from the obtained transformants to identify a plasmid with the insertion of the PCR product of interest and the plasmid was named pVK9::PmsrA-pyc.

<4-3-2> Introduction of pVK9::PmsrA-pyc

The plasmid pVK9::PmsrA-pyc was introduced to the FKS0121 strain, the FKS0121 ΔsucE1 strain, and the FKS0121 ΔynfM strain by the electrical pulse method. The bacterial cells were applied onto CM-Dex-agar medium containing 25 μg/mL of kanamycin and cultured at 31.5° C. Respective grown strains were purified with plates containing the same medium and named FKS0121/pVK9::PmsrA-pyc strain, FKS0121 ΔsucE1/pVK9::PmsrA-pyc strain, and FKS0121 ΔynfM/pVK9::PmsrA-pyc strain.

<4-4> Effect of the Deletion of the sucE1 Gene or the ynfM Gene on the Production of L-Glutamic Acid in the Host FKS0121/pVK9::PmsrA-pyc Strain The FKS0121/pVK9::PmsrA-pyc strain, the FKS0121 ΔsucE1 I pVK9::PmsrA-pyc strain, and the FKS0121 ΔynfM pVK9::PmsrA-pyc strain, all of which were obtained by culturing on CM-Dex plating medium, were each inoculated into 300 mL of a medium for jar evaluation (glucose, 100 g/L; MgSO$_4$.7H$_2$O, 0.5 g/L; H$_3$PO$_4$, 2 g/L; soy bean hydrolysate, 1 g/L; (NH$_4$)$_2$SO$_4$, 10 g/L; FeSO$_4$.7H$_2$O, 20 mg/L; MnSO$_4$.5H$_2$O, 20 mg/L; VB1.HCl, 1 mg/L; biotin 3 mg/L; GD-113 (antifoaming agent), 0.65 mL/L; adjusted to pH 6.5 with KOH) containing 25 μg/mL of kanamycin and cultured at 31.5° C. for 18 hours using a jar fermenter with 80 mL/min of aeration rate, 20 mL/min of CO$_2$ flow rate, and 300 rpm of stirring speed. Additionally, ammonia was added as appropriate during the culture period so that the pH of the culture was maintained at 6.5.

After the completion of the culture, the concentrations of glutamic acid accumulated and the sugar remaining in the medium were analyzed with the Biotech Analyzer AS-310 (Sakura SI Co. Ltd.). Moreover, the amount of succinic acid was analyzed with a liquid chromatography HPLC system (L-7100, L-7200, L-7300, or L-7400; Hitachi High-Technologies Co.) and the URUTRON PS-80H column (Shinwa Chemical Industries Ltd.). The turbidity (OD) of the bacterial cell suspension was measured using the Spectrophotometer U-2900 (Hitachi).

The results are shown in Table 2. The ability to produce succinic acid was decreased and the ability to produce L-glutamic acid was increased in the FKS0121 ΔsucE1/pVK9::PmsrA-pyc strain deficient in the sucE1 gene and the FKS0121 ΔynfM/pVK9::PmsrA-pyc strain deficient in the ynfM gene as compared with the control FKS0121/pVK9::PmsrA-pyc strain. From the above results, it was revealed that the ability to produce glutamic acid is increased by deleting dicarboxylic acid exporter gene(s) also in the coryneform bacterium.

TABLE 2

|  | OD620 nm | Yield of succinic acid (%) | Yield of glutamic acid (%) |
|---|---|---|---|
| FKS0121/pVK9::PmsrA-pyc | 16.5 | 19.1 | 9.5 |
| FKS0121 ΔsucE1/pVK9::PmsrA-pyc | 17.1 | 5.3 | 10.4 |
| FKS0121 ΔynfM/pVK9::PmsrA-pyc | 16.4 | 17.0 | 10.4 |

Example 5: Effects of Dicarboxylic Acid Exporter Protein Deficiency in Glutamate Production by *Brevibacterium lactofermentum* (2)

In this Example, dicarboxylic acid exporter gene-deficient strains derived from *Brevibacterium lactofermentum* (*Corynebacterium glutamicum*) 2256 (ATCC 13869), into which the malyl-CoA pathway was introduced, were constructed to produce glutamic acid.

<5-1> Construction of the FKS0121/pVS7::PmsrA-pyc+pVK9::GGMM Strain, the FKS0121 ΔsucE1/pVS7::PmsrA-pyc+pVK9::GGMM Strain, and the FKS0121 ΔynfM/pVS7::PmsrA-pyc+pVK9::GGMM Strain <5-1-1> Construction of the Plasmid pVS7::PmsrA-pyc for Expression of the pyc Gene The plasmid pVS7::PmsrA-pyc for expression of the pyc gene derived from *B. lactofermentum* 2256 was produced by the method described below. First, the pyc gene was linked by cross-over PCR to the promoter of the msrA gene derived from *B. lactofermentum* 2256. Specifically, a PCR was performed using the genomic DNA of the *B. lactofermentum* strain 2256 as a template and synthetic DNA primers as shown in SEQ ID NOs: 259 and 260 to obtain a PCR product containing the promoter region of the msrA gene. Separately, a PCR was performed using the genomic DNA of the *B. lactofermentum* strain 2256 as a template and synthetic DNA primers as shown in SEQ ID NOs: 261 and 262 to obtain a PCR product containing the ORF region of the pyc gene. SEQ ID NOs: 260 and 261 have complementary sequences. Next, the PCR products containing the promoter region of the msrA gene and the ORF region of the pyc gene were mixed in almost equimolar amounts and a PCR was performed using synthetic DNA primers as shown in SEQ ID NOs: 263 and 264 to obtain the pyc gene fragment linked to the promoter of the msrA gene. Then, the fragment was inserted into the pVS7 vector (WO2013069634) treated with BamHI and PstI by using the In Fusion HD cloning kit (manufactured by Clontech Laboratories, Inc.). Incidentally, the pVS7 is a shuttle vector for *Corynebacterium* bacteria and *E. coli*. Competent cells of *Escherichia coli* JM109

(Takara Shuzo Co., Ltd.) were transformed with this DNA and applied onto LB medium containing 100 μM IPTG; 40 μg/mL X-Gal, and 50 μg/mL spectinomycin and cultured overnight. Then, formed white colonies were picked up and subjected to single-colony isolation to obtain transformants. Plasmids were extracted from the obtained transformants to identify a plasmid with the insertion of the PCR product of interest and the plasmid was named pVS7::PmsrA-pyc.

<5-1-2> Construction of the Plasmid pVK9::GGMM for Expression of the malyl-CoA Pathway The method of introducing the malyl-CoA pathway described in WO 2013/018734 is known as a method for increasing Glu flux through the reductive TCA cycle. The malyl-CoA pathway can be introduced by introducing, for example, the glxR gene, the gcl gene, the mcl gene, and the mtk gene. The glxR gene is a gene encoding a 2-hydroxy-3-oxopropionate reductase, the gcl gene is a gene encoding a glyoxylate carboligase, the mcl gene is a gene encoding a malyl-CoA lyase, and the mtk gene is a gene encoding a malate thiokinase. Thus, the plasmid pVK9::GGMM for expression of the glxR gene, the gcl gene, the mcl gene, and the mtk gene was produced by the method described below. DNA of the glxR-gcl gene region of *Rhodococcus jostii* (SEQ ID NO: 265), and DNA of the lac promoter sequence linked with the mcl-mtk gene region of *Methylococcus capsulatus* (SEQ ID NO: 266) were each chemically synthesized (GenScript Japan Inc.). Next, a PCR was performed using the chemically synthesized DNA as shown in SEQ ID NO: 265 as a template, synthetic DNA primers as shown in SEQ ID NOs: 267 and 268, and Prime Star polymerase (manufactured by Takara Bio Inc.). Moreover, a PCR was performed using the chemically synthesized DNA as shown in SEQ ID NO: 266 as a template, synthetic DNA primers as shown in SEQ ID NOs: 269 and 270, and Prime Star polymerase (manufactured by Takara Bio Inc.). In either case, the reaction solution was adjusted according to the composition attached to the kit and the reaction was performed in 30 cycles of 98° C. for 10 seconds, 55° C. for 5 seconds, and 72° C. for 180 seconds. As a result, a PCR product containing the glxR-gcl gene cluster and a PCR product containing the lac promoter sequence linked with the mcl-mtk gene cluster were obtained. Furthermore, a PCR was performed using pVK9 (WO2007/046389) as a template, synthetic DNA primers as shown in SEQ ID NOs: 271 and 272, and Prime Star polymerase (manufactured by Takara Bio Inc.). The reaction solution was adjusted according to the composition attached to the kit and the reaction was performed in 30 cycles of 98° C. for 10 seconds, 55° C. for 5 seconds, and 72° C. for 360 seconds to obtain a PCR product containing the sequence of pVK9. Then, the obtained three PCR products were linked together by using the In-Fusion HD Cloning Kit (manufactured by Clontech Laboratories, Inc.). The obtained plasmid was named pVK9-GGMM.

<5-1-3> Introduction of pVS7::PmsrA-pyc and pVK9::GGMM

The plasmids pVS7::PmsrA-pyc and pVK9::GGMM were introduced to the FKS0121 strain, the FKS0121 ΔsucE1 strain, and the FKS0121 ΔynfM strain by the electrical pulse method. The bacterial cells were applied onto CM-Dex-agar medium containing 25 μg/mL of kanamycin and 50 μg/mL of spectinomycin and cultured at 31.5° C. Respective grown strains were purified with plates containing the same medium and named FKS0121/pVS7::PmsrA-pyc+pVK9::GGMM strain, FKS0121 ΔsucE1/ pVS7::PmsrA-pyc+pVK9::GGMM strain, and FKS0121 ΔynfM/pVS7::PmsrA-pyc+pVK9::GGMM strain.

<5-2> Effect of the Deletion of the sucE1 Gene or the ynfM Gene on the Production of L-Glutamic Acid in the Host FKS0121/pVS7::PmsrA-pyc+pVK9::GGMM Strain The FKS0121/pVS7::PmsrA-pyc+pVK9::GGMM strain, the FKS0121 ΔsucE1/pVS7::PmsrA-pyc+pVK9::GGMM strain, and the FKS0121 ΔynfM/pVS7::PmsrA-pyc+pVK9::GGMM strain, all of which were obtained by culturing on CM-Dex plating medium, were each inoculated into 3 mL of a test-tube medium (glucose, 20 g/L; urea, 4 g/L; $KH_2PO_4$, 0.5 g/L; $K_2HPO_4$ 0.5 g/L; $(NH_4)_2SO_4$ 14 g/L; $FeSO_4 \cdot 7H_2O$ 20 mg/L; $MnSO_4 \cdot 5H_2O$ 20 mg/L; $MgSO_4 \cdot 7H_2O$ 0.5 g/L; VB1.HCl 0.2 mg/L; biotin 0.2 mg/L; yeast extract, 1/gl; Casamino acids, 1 g/L; no pH adjustment) and cultured with shaking at 31.5° C. for about 16 hours. A 300 μL aliquot of the culture broth was mixed with 300 μL of a glutamic acid-production medium (glucose, 100 g/L; $(NH_4)_2SO_4$, 2 g/L; HEPES (adjusted to pH 8.2 with KOH), 0.2 M; $NaCO_3$, 0.2 M) dispensed in a 1.5 mL Eppendorf tube and incubated with shaking under anaerobic conditions at 32° C. for 48 hours.

After the completion of the culture, the concentrations of glutamic acid accumulated and the sugar remaining in the medium were analyzed with the Biotech Analyzer AS-310 (Sakura SI Co. Ltd.). Moreover, the amount of succinic acid was analyzed with a liquid chromatography HPLC system (L-7100, L-7200, L-7300, or L-7400; Hitachi High-Technologies Co.) and the URUTRON PS-80H column (Shinwa Chemical Industries Ltd.). The turbidity (OD) of the bacterial cell suspension was measured using the Spectrophotometer U-2900 (Hitachi).

The results are shown in Table 3. The yield of succinic acid was significantly decreased and the yield of glutamic acid was increased by about 7% in the FKS0121 ΔsucE1/ pVS7::PmsrA-pyc+pVK9::GGMM strain deficient in the sucE11 gene as compared with the control FKS0121/pVS7:: PmsrA-pyc+pVK9::GGMM strain. Moreover, any change in the yield of succinic acid was not observed but the yield of L-glutamic acid was increased by about 2% in the FKS0121 ΔynfM/pVS7::PmsrA-pyc+pVK9::GGMM strain deficient in the ynfM gene as compared with the control FKS0121/ pVS7::PmsrA-pyc+pVK9::GGMM strain. From the above results, it was revealed that the ability to produce glutamic acid is increased by deleting dicarboxylic acid exporter genes also in the bacterial strain into which the malyl-CoA pathway has been introduced.

TABLE 3

|  | Yield of succinic acid ± S.E. (%) | Yield of glutamic acid ± S.E. (%) |
|---|---|---|
| FKS0121/ pVS7::PmsrA-pyc + pVK9::GGMM | 43 ± 1.7 | 9.8 ± 0.89 |
| FKS0121 ΔsucE1/ pVS7::PmsrA-pyc + pVK9::GGMM | 11 ± 4.2 | 17 ± 1.8 |
| FKS0121 ΔynfM/ pVS7::PmsrA-pyc + pVK9::GGMM | 43 ± 1.5 | 12 ± 0.77 |

Example 6: Effects of Dicarboxylic Acid Exporter Protein Deficiency in Glutamate Production by *E. coli* (2)

In this Example, dicarboxylic acid exporter gene-deficient strains derived from *E. coli* MG1655 (ATCC 47076) were constructed to produce glutamic acid.

<6-1> Construction of the MG1655 ΔsucA ΔgadA ΔgadB ΔiscR Δldh ΔpflD ΔpflB ΔptsG Strain The MG1655 ΔsucA ΔgadA ΔgadB ΔiscR Δldh ΔpflD ΔpflB ΔptsG strain was constructed by further deleting the ptsG gene on the genome of the MG1655 ΔsucA ΔgadA ΔgadB ΔiscR Δldh ΔpflD ΔpflB strain obtained in Example <1-2>. This strain was produced according to the method described in Example <1-2>, i.e. by preparing P1 phage from a ptsG gene-deficient strain in the Keio collection (Baba, T., Ara, T., Hasegawa, M., Takai, Y, Okumura, Y, Baba, M., Datsenko, K. A., Tomita, M., Wanner, B. L., and Mori, H. (2006) Construction of *Escherichia coli* K-12 in-frame, single-gene knockout mutants: the Keio collection. Mol Syst Biol 2: 2006 0008) and performing P1 transformation to the strain of interest, and subsequent deletion of a drug-resistance gene used as a selection marker.

<6-2> Construction of the MG1655 ΔsucA ΔgadA ΔgadB ΔiscR Δldh ΔpflD ΔpflB ΔptsG Δppc Strain The MG1655 ΔsucA ΔgadA ΔgadB ΔiscR Δldh ΔpflD ΔpflB ΔptsG Δppc strain was constructed by further deleting the ppc gene on the genome of the MG1655 ΔsucA ΔgadA ΔgadB ΔiscR Δldh ΔpflD ΔpflB ΔptsG strain.

First, MG1655 ΔsucA ΔgadA ΔgadB ΔiscR Δldh ΔpflD ΔpflB Δppc::Cm was produced by the λ-Red method. A PCR reaction was performed using primers as shown in SEQ ID NOs: 281 and 282 (each containing a partial sequence of the ppc gene and either the attL sequence or the attR sequence) and pMW118-attL-Cm-attR as a template. The obtained DNA fragment was digested with DpnI restriction enzyme and introduced by electroporation to the MG1655 ΔsucA ΔgadA ΔgadB ΔiscR Δldh ΔpflD ΔpflB strain containing the plasmid pKD46, which has an ability to replicate in a thermo-sensitive manner. Chloramphenicol-resistant recombinants were selected by culturing at 30° C. on LB-agar medium containing Amp (ampicillin; 50 mg/L) and Cm (chloramphenicol; 20 mg/L). A colony PCR was performed using primers as shown in SEQ ID NOs: 283 and 284 to select a strain in which the ppc gene on the genome was replaced with ppc::Cm. The selected strain was named MG1655 ΔsucA ΔgadA ΔgadB ΔiscR Δldh ΔpflD ΔpflB Δppc::Cm.

Next, P1 transduction was performed using MG1655 ΔsucA ΔgadA ΔgadB ΔiscR Δldh ΔpflD ΔpflB Δppc::Cm as a donor and MG1655 ΔsucA ΔgadA ΔgadB ΔiscR Δldh ΔpflD ΔpflB ΔptsG as a recipient to obtain MG1655 ΔsucA ΔgadA ΔgadB ΔiscR Δldh ΔpflD ΔpflB ΔptsG Δppc::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the MG1655 ΔsucA ΔgadA ΔgadB ΔiscR Δldh ΔpflD ΔpflB ΔptsG Δppc strain.

<6-3> Construction of the MG1655 ΔsucA ΔgadA ΔgadB ΔiscR ΔpflD ΔpflB ΔptsG Δppc Δldh::pckA Strain (E7-42 Strain)

A strain carrying the pckA gene linked to the P4071φ10 promoter was produced by the λ-Red method, in which strain the pckA gene was integrated into the lactate dehydrogenase gene (ldh) locus on the genome of the MG1655 ΔsucA ΔgadA ΔgadB ΔiscR Δldh ΔpflD ΔpflB ΔptsG Δppc strain. A PCR reaction was performed using primers as shown in SEQ ID NOs: 285 and 286 (each containing either a partial sequence of the upstream region or downstream region of the ldh gene and either the attL sequence or the attR sequence) and the genome of the *Enterobacter aerogenes* ES04 ΔpoxB::λattL-Km$^r$-λattR-P4701φ10-pckA strain as a template. Incidentally, the ES04 ΔpoxB::λattL-Km$^r$-λattR-P4701φ10-pckA strain is a strain obtained by replacing the Ptac promoter sequence (SEQ ID NO: 287) in the ES04 ΔpoxB::λattL-Km$^r$-λattR-Ptac-pckA strain described in Example <2-1> with the P4701φ10 promoter sequence (SEQ ID NO: 288). The obtained DNA fragment was digested with DpnI restriction enzyme and introduced by electroporation to the MG1655 ΔsucA ΔgadA ΔgadB ΔiscR ΔpflD ΔpflB ΔptsG Δppc strain containing the plasmid pKD46, which has an ability to replicate in a thermo-sensitive manner. Kanamycin-resistant recombinants were selected by culturing at 30° C. on LB-agar medium containing Amp (ampicillin; 50 mg/L) and Km (kanamycin; 50 mg/L) to obtain the MG1655 ΔsucA ΔgadA ΔgadB ΔiscR ΔpflD ΔpflB ΔptsG Δppc Δldh::Km-pckA strain. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the MG1655 ΔsucA ΔgadA ΔgadB ΔiscR ΔpflD ΔpflB ΔptsG Δppc Δldh::pckA strain. This strain was named E7-42 strain.

<6-4> Construction of Strains Each Deficient in Succinic Acid Exporter Gene(s) from the E7-42 Strain <6-4-1> Construction of the E7-42 ΔyjjP Strain The E7-42 ΔyjjP strain was constructed by further deleting the yjjP gene on the genome of the E7-42 strain. This strain was produced according to the method described in Example <1-2>, i.e. by preparing P1 phage from a yjjP gene-deficient strain in the Keio collection (Baba, T., Ara, T., Hasegawa, M., Takai, Y, Okumura, Y, Baba, M., Datsenko, K. A., Tomita, M., Wanner, B. L., and Mori, H. (2006) Construction of *Escherichia coli* K-12 in-frame, single-gene knockout mutants: the Keio collection. Mol Syst Biol 2: 2006 0008) and performing P1 transformation to the E7-42 strain, and subsequent deletion of a drug-resistance gene used as a selection marker.

<6-4-2> Construction of the E7-42 ΔyjjP ΔyeeA ΔynfM Strain

The E7-42 ΔyjjP ΔyeeA ΔynfM strain was constructed by further deleting the yeeA and ynfM genes on the genome of the E7-42 ΔyjjP strain.

First, P1 transduction was performed using MG1655 ΔyeeA::Cm (described in Example <1-5>) as a donor and the E7-42 ΔyjjP strain as a recipient to obtain E7-42 ΔyjjP ΔyeeA::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the E7-42 ΔyjjP ΔyeeA strain.

Next, P1 transduction was performed using MG1655 ΔynJM::Cm (described in Example <1-5>) as a donor and the E7-42 ΔyjjP ΔyeeA strain as a recipient to obtain E7-42 ΔyjjP ΔyeeA ΔynfM::Cm. Then, the pMW-int-xis plasmid was introduced to this strain by electroporation, and strains resistant to Amp were selected at 30° C., followed by single-colony isolation of the obtained strains at 42° C. to obtain a strain of interest which had lost the drug-resistance cassette and the plasmid: the E7-42 ΔyjjP ΔyeeA ΔynfM strain.

<6-5> Confirmation of Glutamate Production in Anaerobic Culture

Strains were produced by simultaneously introducing the RSFCPG plasmid (see EP0952221) and the pMW219-Fd- KGSPS plasmid (described in Example <1-6>) to each of the strains E7-42, E7-42 ΔyjjP and E7-42 ΔyjjP ΔyeeA ΔynfM Next, the L-glutamate production culture was performed by using the produced bacterial strains to examine the ability to produce L-glutamic acid. The bacterial strains were uniformly applied onto LBM9Glc plates (produced by adding 200 mL of 5×M9 salts and 10 mL of 50% glucose to 800 mL of LB medium) containing a suitable antibiotic (50 μg/mL of kanamycin or 15 μg/mL of tetracycline) and cultured at 37° C. for 16-20 hours. Then, those plates were placed into an AnaeroPack pouch (manufactured by Mitsubishi Gas Chemical Company, Inc.; for easy cultivation of anaerobic bacteria; Product Number: A-04) and incubated under anaerobic conditions at 37° C. for 6 hours. Obtained bacterial cells on the plates were suspended in 700 μL of 0.8% saline to give an optical density (OD) of 0.5 to 1.5 (600 nm) when diluted 51 times. To a microtube having a volume of 1.5 mL, 200 μl of this bacterial cell suspension and 1 mL of the production medium purged with a sufficient amount of carbon dioxide gas in advance (1 vvm, 30 minutes or longer) were placed and covered tightly with a cap and then incubated using a microtube shaker under anaerobic conditions at 37° C. for 24 or 48 hours. The composition of the production medium is shown below.

The composition of the production medium

| Part A: | |
|---|---|
| Glucose | 10 g/L (final concentration) |
| Part B: | |
| Magnesium sulfate heptahydrate | 1 g/L |
| Ammonium sulfate | 15 g/L |
| Monopotassium phosphate | 1 g/L |
| Biotin | 1 mg/L |
| Vitamin B1 | 1 mg/L |
| $FeSO_4 \cdot 7H_2O$ | 10 mg/L |
| (adjusted to pH = 7 with KOH) | |
| Part C: | |
| Calcium carbonate (Japanese Pharmacopeia) | 50 g/L |

After Part A and Part B were separately sterilized by autoclaving at 115° C. for 10 minutes and Part C was sterilized by dry-heating at 180° C. for 3 hours, they were left to cool and then mixed.

After the culture, the concentrations of glutamic acid accumulated and the sugar remaining in the medium were analyzed with the Biotech Analyzer AS-310 (Sakura SI Co. Ltd.). Moreover, the amounts of other organic acids were analyzed with a liquid chromatography HPLC system (L-7100, L-7200, L-7300, or L-7400; Hitachi High-Technologies Co.) and the URUTRON PS-80H column (Shinwa Chemical Industries Ltd.). The turbidity (OD) of the bacterial cell suspension was measured using the Spectrophotometer DU800 (Beckman Coulter) after calcium carbonate in the medium was dissolved by diluting the sample with 0.1 N hydrochloric acid.

The results are shown in Table 4. The ability to produce L-glutamic acid was increased in the E7-42 ΔyjjP (RSFCPG, pMW219-FdKGSPS) strain deficient in the yjjP gene and in the E7-42 ΔyjjP ΔyeeA ΔynfM (RSFCPG, pMW219-FdK-GSPS) strain further deficient in the ynfM and yeeA genes as compared with the control E7-42 (RSFCPG, pMW219-FdKGSPS) strain. From the above results, it was revealed that the ability to produce glutamic acid is increased by deleting dicarboxylic acid exporter gene(s) also in E. coli.

TABLE 4

| Strains to be evaluated (*1) | Yield of glutamic acid ± S.E. (%) | Yield of succinic acid ± S.E. (%) |
|---|---|---|
| E7-42 | 5.7 ± 0.2 | 54.3 ± 1.5 |
| E7-42 ΔyjjP | 6.3 ± 0.2 | 42.4 ± 2.5 |
| E7-42 ΔyjjP ΔynfM ΔyeeA | 7.9 ± 0.3 | 40.1 ± 1.4 |

(*1) each strain carries both RSFCPG and pMW219-FdKGSPS plasmids.

INDUSTRIAL APPLICABILITY

According to the present invention, the ability of a microorganism to produce an objective substance can be improved, and the objective substance can be produced efficiently.

<Explanation of Sequence Listing>

SEQ ID NO: 1: Nucleotide sequence of nuo operon of E. coli MG1655

SEQ ID NOS: 2 to 14: Amino acid sequences of proteins encoded by nuo operon of E. coli MG1655

SEQ ID NO: 15: Nucleotide sequence of nuo operon of Pantoea ananatis AJ13355

SEQ ID NOS: 16 to 28: Amino acid sequences of proteins encoded by nuo operon of Pantoea ananatis AJ13355

SEQ ID NO: 29: Nucleotide sequence of ndh gene of E. coli MG1655

SEQ ID NO: 30: Amino acid sequence of Ndh protein of E. coli MG1655

SEQ ID NO: 31: Nucleotide sequence of ndh gene of Pantoea ananatis AJ13355

SEQ ID NO: 32: Amino acid sequence of Ndh protein of Pantoea ananatis AJ13355

SEQ ID NO: 33: Nucleotide sequence of mqo gene of E. coli MG1655

SEQ ID NO: 34: Amino acid sequence of Mqo protein of E. coli MG1655

SEQ ID NO: 35: Nucleotide sequence of mqo1 gene of Pantoea ananatis AJ13355

SEQ ID NO: 36: Amino acid sequence of a protein encoded by mqo1 gene of Pantoea ananatis AJ13355

SEQ ID NO: 37: Nucleotide sequence of ldhA gene of E. coli MG1655

SEQ ID NO: 38: Amino acid sequence of LdhA protein of E. coli MG1655

SEQ ID NO: 39: Nucleotide sequence of ldhA gene of Pantoea ananatis AJ13355

SEQ ID NO: 40: Amino acid sequence of LdhA protein of Pantoea ananatis AJ13355

SEQ ID NO: 41: Nucleotide sequence of adhE gene of E. coli MG1655

SEQ ID NO: 42: Amino acid sequence of AdhE protein of E. coli MG1655

SEQ ID NO: 43: Nucleotide sequence of adhE gene of Pantoea ananatis AJ13355

SEQ ID NO: 44: Amino acid sequence of AdhE protein of Pantoea ananatis AJ13355

SEQ ID NO: 45: Nucleotide sequence of pta gene of E. coli MG1655

SEQ ID NO: 46: Amino acid sequence of Pta protein of E. coli MG1655

SEQ ID NO: 47: Nucleotide sequence of pta gene of Pantoea ananatis AJ13355

SEQ ID NO: 48: Amino acid sequence of Pta protein of *Pantoea ananatis* AJ13355

SEQ ID NO: 49: Nucleotide sequence of α-subunit gene of α-ketoglutarate synthase of *Chlorobium tepidum*

SEQ ID NO: 50: Amino acid sequence of α-subunit of α-ketoglutarate synthase of *Chlorobium tepidum*

SEQ ID NO: 51: Nucleotide sequence of β-subunit gene of α-ketoglutarate synthase of *Chlorobium tepidum*

SEQ ID NO: 52: Amino acid sequence of β-subunit of α-ketoglutarate synthase of *Chlorobium tepidum*

SEQ ID NO: 53: Nucleotide sequence of α-subunit gene of α-ketoglutarate synthase of *Blastopirellula marina*

SEQ ID NO: 54: Amino acid sequence of α-subunit of α-ketoglutarate synthase of *Blastopirellula marina*

SEQ ID NO: 55: Nucleotide sequence of β-subunit gene of α-ketoglutarate synthase of *Blastopirellula marina*

SEQ ID NO: 56: Amino acid sequence of β-subunit of α-ketoglutarate synthase of *Blastopirellula marina*

SEQ ID NO: 57: Nucleotide sequence of fpr gene of *E. coli* K-12

SEQ ID NO: 58: Amino acid sequence of Fpr protein of *E. coli* K-12

SEQ ID NO: 59: Nucleotide sequence of pyruvate synthase gene of *Chlorobium tepidum*

SEQ ID NO: 60: Amino acid sequence of pyruvate synthase of *Chlorobium tepidum*

SEQ ID NO: 61: Nucleotide sequence of fdx gene of *E. coli* K-12

SEQ ID NO: 62: Amino acid sequence of Fdx protein of *E. coli* K-12

SEQ ID NO: 63: Nucleotide sequence of yfhL gene of *E. coli* K-12

SEQ ID NO: 64: Amino acid sequence of YfhL protein of *E. coli* K-12

SEQ ID NO: 65: Nucleotide sequence of fldA gene of *E. coli* K-12

SEQ ID NO: 66: Amino acid sequence of FldA protein of *E. coli* K-12

SEQ ID NO: 67: Nucleotide sequence of fldB gene of *E. coli* K-12

SEQ ID NO: 68: Amino acid sequence of FldB protein of *E. coli* K-12

SEQ ID NO: 69: Nucleotide sequence of ferredoxin I gene of *Chlorobium tepidum*

SEQ ID NO: 70: Amino acid sequence of ferredoxin I of *Chlorobium tepidum*

SEQ ID NO: 71: Nucleotide sequence of ferredoxin II gene of *Chlorobium tepidum*

SEQ ID NO: 72: Amino acid sequence of ferredoxin II of *Chlorobium tepidum*

SEQ ID NO: 73: Nucleotide sequence of sucA gene of *Pantoea ananatis* AJ13355

SEQ ID NO: 74: Amino acid sequence of SucA protein of *Pantoea ananatis* AJ13355

SEQ ID NO: 75: Nucleotide sequence of sucB gene of *Pantoea ananatis* AJ13355

SEQ ID NO: 76: Amino acid sequence of SucB protein of *Pantoea ananatis* AJ13355

SEQ ID NO: 77: Nucleotide sequence of lpdA gene of *Pantoea ananatis* AJ13355

SEQ ID NO: 78: Amino acid sequence of LpdA protein of *Pantoea ananatis* AJ13355

SEQ ID NO: 79: Nucleotide sequence of odhA gene of *Corynebacterium glutamicum* ATCC13032

SEQ ID NO: 80: Amino acid sequence of E1o subunit of *Corynebacterium glutamicum* ATCC13032

SEQ ID NO: 81: Nucleotide sequence of lpd gene of *Corynebacterium glutamicum* ATCC13032

SEQ ID NO: 82: Amino acid sequence of E3 subunit of *Corynebacterium glutamicum* ATCC13032

SEQ ID NO: 83: Nucleotide sequence of NCgl2126 gene of *Corynebacterium glutamicum* ATCC13032

SEQ ID NO: 84: Amino acid sequence of a protein encoded by NCgl2126 gene of *Corynebacterium glutamicum* ATCC13032

SEQ ID NO: 85: Nucleotide sequence of ndh gene of *Corynebacterium glutamicum* ATCC13032

SEQ ID NO: 86: Amino acid sequence of Ndh protein of *Corynebacterium glutamicum* ATCC13032

SEQ ID NO: 87: Nucleotide sequence of mqo gene of *Corynebacterium glutamicum* ATCC13032

SEQ ID NO: 88: Amino acid sequence of Mqo protein of *Corynebacterium glutamicum* ATCC13032

SEQ ID NO: 89: Nucleotide sequence of pflB gene of *E. coli* MG1655

SEQ ID NO: 90: Amino acid sequence of PflB protein of *E. coli* MG1655

SEQ ID NO: 91: Nucleotide sequence of pflD gene of *E. coli* MG1655

SEQ ID NO: 92: Amino acid sequence of PflD protein of *E. coli* MG1655

SEQ ID NO: 93: Nucleotide sequence of tdcE gene of *E. coli* MG1655

SEQ ID NO: 94: Amino acid sequence of TdcE protein of *E. coli* MG1655

SEQ ID NO: 95: Nucleotide sequence of pflB gene of *Pantoea ananatis* AJ13355

SEQ ID NO: 96: Amino acid sequence of PflB protein of *Pantoea ananatis* AJ13355

SEQ ID NO: 97: Nucleotide sequence of mqo2 gene of *Pantoea ananatis* AJ13355

SEQ ID NO: 98: Amino acid sequence of a protein encoded by mqo2 gene of *Pantoea ananatis* AJ13355

SEQ ID NO: 99: Nucleotide sequence of mtkA gene of *Methylobacterium extorquens* AM1

SEQ ID NO: 100: Amino acid sequence of MtkA protein of *Methylobacterium extorquens* AM1

SEQ ID NO: 101: Nucleotide sequence of mtkB gene of *Methylobacterium extorquens* AM1

SEQ ID NO: 102: Amino acid sequence of MtkB protein of *Methylobacterium extorquens* AM1

SEQ ID NO: 103: Nucleotide sequence of mtkA gene of *Mesorhizobium loti* MAFF303099

SEQ ID NO: 104: Amino acid sequence of MtkA protein of *Mesorhizobium loti* MAFF303099

SEQ ID NO: 105: Nucleotide sequence of mtkB gene of *Mesorhizobium loti* MAFF303099

SEQ ID NO: 106: Amino acid sequence of MtkB protein of *Mesorhizobium loti* MAFF303099

SEQ ID NO: 107: Nucleotide sequence of mtkA gene of *Granulibacter bethesdensis* CGDNIH1

SEQ ID NO: 108: Amino acid sequence of MtkA protein of *Granulibacter bethesdensis* CGDNIH1

SEQ ID NO: 109: Nucleotide sequence of mtkB gene of *Granulibacter bethesdensis* CGDNIH1

SEQ ID NO: 110: Amino acid sequence of MtkB protein of *Granulibacter bethesdensis* CGDNIH1

SEQ ID NO: 111: Nucleotide sequence of sucC gene of *E. coli* MG1655

SEQ ID NO: 112: Amino acid sequence of SucC protein of *E. coli* MG1655

SEQ ID NO: 113: Nucleotide sequence of sucD gene of *E. coli* MG1655

SEQ ID NO: 114: Amino acid sequence of SucD protein of *E. coli* MG1655

SEQ ID NO: 115: Nucleotide sequence of sucC gene of *Pantoea ananatis* AJ13355

SEQ ID NO: 116: Amino acid sequence of SucC protein of *Pantoea ananatis* AJ13355

SEQ ID NO: 117: Nucleotide sequence of sucD gene of *Pantoea ananatis* AJ13355

SEQ ID NO: 118: Amino acid sequence of SucD protein of *Pantoea ananatis* AJ13355

SEQ ID NO: 119: Nucleotide sequence of sucC gene of *Corynebacterium glutamicum* ATCC13032

SEQ ID NO: 120: Amino acid sequence of SucC protein of *Corynebacterium glutamicum* ATCC13032

SEQ ID NO: 121: Nucleotide sequence of sucD gene of *Corynebacterium glutamicum* ATCC13032

SEQ ID NO: 122: Amino acid sequence of SucD protein of *Corynebacterium glutamicum* ATCC13032

SEQ ID NO: 123: Nucleotide sequence of sucC gene of *Corynebacterium glutamicum* 2256 (ATCC13869)

SEQ ID NO: 124: Amino acid sequence of SucC protein of *Corynebacterium glutamicum* 2256 (ATCC13869)

SEQ ID NO: 125: Nucleotide sequence of sucD gene of *Corynebacterium glutamicum* 2256 (ATCC13869)

SEQ ID NO: 126: Amino acid sequence of SucD protein of *Corynebacterium glutamicum* 2256 (ATCC13869)

SEQ ID NO: 127: Nucleotide sequence of Ca_smtA gene of *Chloroflexus aurantiacus* J-10-fl SEQ ID NO: 128: Amino acid sequence of Ca_SmtA protein of *Chloroflexus aurantiacus* J-10-fl SEQ ID NO: 129: Nucleotide sequence of Ca_smtB gene of *Chloroflexus aurantiacus* J-10-fl SEQ ID NO: 130: Amino acid sequence of Ca_SmtB protein of *Chloroflexus aurantiacus* J-10-fl SEQ ID NO: 131: Nucleotide sequence of Ap_smtA gene of Candidatus *Accumulibacter phosphatis* clade IIA str. UW-1

SEQ ID NO: 132: Amino acid sequence of Ap_SmtA protein of Candidatus *Accumulibacter phosphatis* clade IIA str. UW-1

SEQ ID NO: 133: Nucleotide sequence of Ap_smtB gene of Candidatus *Accumulibacter phosphatis* clade IIA str. UW-1

SEQ ID NO: 134: Amino acid sequence of Ap_SmtB protein of Candidatus *Accumulibacter phosphatis* clade IIA str. UW-1

SEQ ID NO: 135: Nucleotide sequence of Rr_smt gene of *Rhodospirillum rubrum* ATCC 11170

SEQ ID NO: 136: Amino acid sequence of Rr_Smt protein of *Rhodospirillum rubrum* ATCC 11170

SEQ ID NO: 137: Nucleotide sequence of Mm_smt gene of *Magnetospirillum magneticum* AMB-1

SEQ ID NO: 138: Amino acid sequence of Mm_Smt protein of *Magnetospirillum magneticum* AMB-1

SEQ ID NO: 139: Nucleotide sequence of mclA gene of *Methylobacterium extorquens* AM1

SEQ ID NO: 140: Amino acid sequence of MclA protein of *Methylobacterium extorquens* AM1

SEQ ID NO: 141: Nucleotide sequence of mclA gene of *Mesorhizobium loti* MAFF303099

SEQ ID NO: 142: Amino acid sequence of MclA protein of *Mesorhizobium loti* MAFF303099

SEQ ID NO: 143: Nucleotide sequence of mclA gene of *Granulibacter bethesdensis* CGDNIH1

SEQ ID NO: 144: Amino acid sequence of MclA protein of *Granulibacter bethesdensis* CGDNIH1

SEQ ID NO: 145: Nucleotide sequence of aceA gene of *E. coli* MG1655

SEQ ID NO: 146: Amino acid sequence of AceA protein of *E. coli* MG1655

SEQ ID NO: 147: Nucleotide sequence of aceA gene of *Pantoea ananatis* AJ13355

SEQ ID NO: 148: Amino acid sequence of AceA protein of *Pantoea ananatis* AJ13355

SEQ ID NO: 149: Nucleotide sequence of ICL1 gene of *Corynebacterium glutamicum* ATCC13032

SEQ ID NO: 150: Amino acid sequence of a protein encoded by ICL1 gene of *Corynebacterium glutamicum* ATCC13032

SEQ ID NO: 151: Nucleotide sequence of ICL2 gene of *Corynebacterium glutamicum* ATCC13032

SEQ ID NO: 152: Amino acid sequence of a protein encoded by ICL2 gene of *Corynebacterium glutamicum* ATCC13032

SEQ ID NO: 153: Nucleotide sequence of ICL1 gene of *Corynebacterium glutamicum* 2256 (ATCC13869)

SEQ ID NO: 154: Amino acid sequence of a protein encoded by ICL1 gene of *Corynebacterium glutamicum* 2256 (ATCC13869)

SEQ ID NO: 155: Nucleotide sequence of ICL2 gene of *Corynebacterium glutamicum* 2256 (ATCC13869)

SEQ ID NO: 156: Amino acid sequence of a protein encoded by ICL2 gene of *Corynebacterium glutamicum* 2256 (ATCC13869)

SEQ ID NO: 157: Nucleotide sequence of yjjP gene of *E. coli* MG1655

SEQ ID NO: 158: Amino acid sequence of YjjP protein of *E. coli* MG1655

SEQ ID NO: 159: Nucleotide sequence of yjjP gene of *Enterobacter aerogenes*

SEQ ID NO: 160: Amino acid sequence of YjjP protein of *Enterobacter aerogenes*

SEQ ID NO: 161: Nucleotide sequence of yjjB gene of *E. coli* MG1655

SEQ ID NO: 162: Amino acid sequence of YjjB protein of *E. coli* MG1655

SEQ ID NO: 163: Nucleotide sequence of yjjB gene of *Enterobacter aerogenes*

SEQ ID NO: 164: Amino acid sequence of YjjB protein of *Enterobacter aerogenes*

SEQ ID NO: 165: Nucleotide sequence of yeeA gene of *E. coli* MG1655

SEQ ID NO: 166: Amino acid sequence of YeeA protein of *E. coli* MG1655

SEQ ID NO: 167: Nucleotide sequence of yeeA gene of *Pantoea ananatis* AJ13355

SEQ ID NO: 168: Amino acid sequence of YeeA protein of *Pantoea ananatis* AJ13355

SEQ ID NO: 169: Nucleotide sequence of yeeA gene of *Enterobacter aerogenes*

SEQ ID NO: 170: Amino acid sequence of YeeA protein of *Enterobacter aerogenes*

SEQ ID NO: 171: Nucleotide sequence of ynfM gene of *E. coli* MG1655

SEQ ID NO: 172: Amino acid sequence of YnfM protein of *E. coli* MG1655

SEQ ID NO: 173: Nucleotide sequence of ynfM gene of *Pantoea ananatis* AJ13355

SEQ ID NO: 174: Amino acid sequence of YnfM protein of *Pantoea ananatis* AJ13355

SEQ ID NO: 175: Nucleotide sequence of ynfM gene of *Enterobacter aerogenes*
SEQ ID NO: 176: Amino acid sequence of YnfM protein of *Enterobacter aerogenes*
SEQ ID NO: 177: Nucleotide sequence of ynfM gene of *Corynebacterium glutamicum* ATCC13032
SEQ ID NO: 178: Amino acid sequence of YnfM protein of *Corynebacterium glutamicum* ATCC13032
SEQ ID NO: 179: Nucleotide sequence of ynfM gene of *Corynebacterium glutamicum* 2256 (ATCC13869)
SEQ ID NO: 180: Amino acid sequence of YnfM protein of *Corynebacterium glutamicum* 2256 (ATCC13869)
SEQ ID NOS: 181 to 212: Primers
SEQ ID NO: 213: pckA gene of *Actinobacillus succinogenes* 130Z
SEQ ID NO: 214: PckA protein of *Actinobacillus succinogenes* 130Z
SEQ ID NOS: 215 to 228: Primers
SEQ ID NO: 229: Nucleotide sequence of ldh gene of *Corynebacterium glutamicum* ATCC13032
SEQ ID NO: 230: Amino acid sequence of Ldh protein of *Corynebacterium glutamicum* ATCC13032
SEQ ID NO: 231: Nucleotide sequence of ldh gene of *Corynebacterium glutamicum* 2256 (ATCC13869)
SEQ ID NO: 232: Amino acid sequence of Ldh protein of *Corynebacterium glutamicum* 2256 (ATCC13869)
SEQ ID NO: 233: Nucleotide sequence of adhE gene of *Corynebacterium glutamicum* ATCC13032
SEQ ID NO: 234: Amino acid sequence of AdhE protein of *Corynebacterium glutamicum* ATCC13032
SEQ ID NO: 235: Nucleotide sequence of ilvB gene of *E. coli* MG1655
SEQ ID NO: 236: Amino acid sequence of IlvB protein of *E. coli* MG1655
SEQ ID NO: 237: Nucleotide sequence of ilvI gene of *E. coli* MG1655
SEQ ID NO: 238: Amino acid sequence of IlvI protein of *E. coli* MG1655
SEQ ID NO: 239: Nucleotide sequence of ilvG gene of *Pantoea ananatis* AJ13355
SEQ ID NO: 240: Amino acid sequence of IlvG protein of *Pantoea ananatis* AJ13355
SEQ ID NO: 241: Nucleotide sequence of ilvI gene of *Pantoea ananatis* AJ13355
SEQ ID NO: 242: Amino acid sequence of IlvI protein of *Pantoea ananatis* AJ13355
SEQ ID NO: 243: Nucleotide sequence of ilvB gene of *Corynebacterium glutamicum* ATCC13032
SEQ ID NO: 244: Amino acid sequence of IlvB protein of *Corynebacterium glutamicum* ATCC13032
SEQ ID NO: 245: Nucleotide sequence of budA gene of *Pantoea ananatis* AJ13355
SEQ ID NO: 246: Amino acid sequence of BudA protein of *Pantoea ananatis* AJ13355
SEQ ID NO: 247: Nucleotide sequence of budC gene of *Pantoea ananatis* AJ13355
SEQ ID NO: 248: Amino acid sequence of BudC protein of *Pantoea ananatis* AJ13355
SEQ ID NO: 249: Nucleotide sequence of butA gene of *Corynebacterium glutamicum* ATCC13032
SEQ ID NO: 250: Amino acid sequence of ButA protein of *Corynebacterium glutamicum* ATCC13032
SEQ ID NOS: 251 to 264: Primers
SEQ ID NO: 265: Nucleotide sequence of glxR-glc gene region of *Rhodococcus jostii*
SEQ ID NO: 266: Nucleotide sequence of lac promoter region and mcl-mtk gene region of *Methylococcus capsulatus*
SEQ ID NOS: 267 to 272: Primers
SEQ ID NO: 273: Nucleotide sequence of yggB gene of *Corynebacterium glutamicum* 2256 (ATCC13869)
SEQ ID NO: 274: Amino acid sequence of YggB protein of *Corynebacterium glutamicum* 2256 (ATCC13869)
SEQ ID NO: 275: Nucleotide sequence of pyc gene of *Corynebacterium glutamicum* 2256 (ATCC13869)
SEQ ID NO: 276: Amino acid sequence of Pyc protein of *Corynebacterium glutamicum* 2256 (ATCC13869)
SEQ ID NO: 277: Nucleotide sequence of sucE1 gene of *Corynebacterium glutamicum* ATCC13032
SEQ ID NO: 278: Amino acid sequence of SucE1 protein of *Corynebacterium glutamicum* ATCC13032
SEQ ID NO: 279: Nucleotide sequence of sucE1 gene of *Corynebacterium glutamicum* 2256 (ATCC13869)
SEQ ID NO: 280: Amino acid sequence of SucE1 protein of *Corynebacterium glutamicum* 2256 (ATCC13869)
SEQ ID NOS: 281 to 286: Primers
SEQ ID NO: 287: Ptac promoter
SEQ ID NO: 288: P4701φ10 promoter

SEQUENCE LISTING (288 sequences)

SEQ ID NO: 1 - DNA, 15444 bp, Escherichia coli
atgagtatgtcaacatccactgaagtcatcgctcatcactgggcattcgctatctttcttatcgttgccattggcctgtgttgcctgatgctggtaggcggttggtttttaggcggtcgcgcacgcgcgaggtcgaaaaacgtgccgtttgaatccggtatcgactcggtcggctccgcccgcttacgcctgtccgccaagttttatctggtggccatgttcttcgttatcttcgacgttgaagcgctgtatctgttcgcatggtcaacctctatccgcgaaagcggctgggtaggctttgtggaagctgcaatttttatttttgtgttactggcaggtctggtttatctggtgcgtattggcgcgctggactggacgcccgcgcgttcacgccgcgagcgtatgaacccggaaacgaacagtatcgctaatcgtcaacgctaaccgcgaggcattaagatggattatacgctcacccgcatagatcccaacggtgagaacgaccgttaccccctgcaaaagcaggagatcgtaaccgaccctctggagcaagaagttaacaaaaacgtgtttatgggcaagctcaatgacatggttaactggggtcgtaaaaactcaatttggccgtataacttcggtctttcctgctgttacgttgagatggtgacttcgtttaccgcggtgcatgacgtggcgcgttttggcgcagaagtattgcgtgcttcgccgcgtcaggctgacctgatggtggttgcaggaacctgctttaccaaaatggcaccggttattcagcgtctgtatgaccagatgctggaaccaaaatgggttatctcaatgggtgcctgtgccaactctggtggtatgtacgatatttattccgttgtgcagggcgtcgataaattcatcccggttgatgtgtatatcccgggctgcccgccgcgtcctgaagcgtacatgcaggcactgatgctgttgcaggaatctatcggcaaagaacgtcgtccgctctcctgggtggttggcgatcagggcgtttatcgcgccaatatgcaatcagagcgcgaacgcaagcgcggtgaacgcattgccgtaactaacctgcgtacacctgacgagatttaatttgcgcctgtcggcaaagggatttttcttcgcttattcctaaatctatttcgcgaagcttactgcgccgacagtcaccacggaccatttgcaatggtgaacaatatgaccgacttaaccgcgcaagaacccgcctggcagacccgcgatcatcttgatgatccggtgattggcgaactgcgcaaccgttttgggccggatgcctttactgttcaggcgactcgcaccggggttcccgttgtgtggatcaagcgtgaacaattactggaagttggcgatttcttaaagaaactgccgaaaccttacgtcatgctgtttgacttacacggcatggacgaacgtctgcgcacacaccgcgaagggttacctgccgcggatttttccgttttctaccatctgatttctatcgatcgtaaccgcgacatcatgctgaaggtggcgctggcagaaaacgacctgcacgtaccgaccttcaccaaactgttcccgaacgctaactggtatgagcgtgaaacctgggatctgtttggcattactttcgacggtcacccgaacctgcgacgcatcatgatgccgcaaacctggaaaggtcacccgctgcgtaaagattatccggcgcgcgctaccgaattctcgccgtttgagctgaccaaagccaaacaggatctggagatggaagccctgaccttcaaaccggaagagtgggggatgaagcgcggcaccgaaaacgaggacttcatgttcctcaacctcggtccgaaccacccgtcggcgcacggggctttccgtatcgttttgcaactcgatggcgaagagattgtcgactgcgtaccagacatcggttaccaccaccgtggtgcggagaaaatgggcgaacgccagtcctggcacagctacattccgtatactgaccgtatcgaatacctcggcggctgcgttaacgaaatgccttacgtgctggcggtagagaaactggccgggatcaccgtgccggatcgcgttaacgtcattcgcgttatgctctccgaactgttccgcatcaacagtcacctgctgtatatctcgacctttattcaggacgtcggcgcaatgacgccagtgttcttcgcctttaccgatcgtcagaaaatttacgatctggtggaagcaatcactggtttccgtatgcacccggcgtggttccgtattggcggcgtagcgcacgacctgccgcgcggctgggatcgcctgctgcgtgagttcctcgactggatgccgaaacgtctggcgtcttacgagaaagcggcgctgcaaaacaccattctgaaaggtcgttcccagggcgttgccgcctatggcgcgaaagaggcgctggagtggggcaccactggcgcgggcctgcgtgctaccgggatcgacttcgacgtgcgtaaggcgcgtccttattctggctatgaaaacttcgactttgaaatcccggtgggtggtggcgtttctgactgctacacccgcgtaatgcttaaagtggaagagctgcgccagagtctgcgcattcttgagcagtgcctcaacaacatgccggaaggcccgttcaaagcggatcacccgctgaccacgccgccgccgaaagagcgcacgctgcaacatatcgaaaccctgatcacccacttcctgcaagtgtcgtggggtccggtgatgcctgccaatgaatctttccagatgattgaggcgaccaaagggatcaacagttactacctgaccagcgacggcagcaccatgagttaccgcacccgtgttcgtaccccgagctttgcgcatttgcagcaaattccggcggcgatccgcggcagcctggtgtctgacctgattgtttatctgggcagtatcgattttgttatgtcagatgtggaccgctaattatgcacgagaatcaacaaccacaaaccgaggcttttgagctgagtgcggcagagcgtgaagcgatcgagcacgagatgcaccactacgaagacccgcgtgcggcgtccattgaagcgctgaaaatcgttcagaagcagcgtggctgggtgccggatggtgcgatccacgcgatcgccgatgtgctgggtattccggcaagcgacgtcgaaggtgtggcaacgttctacagtcagatcttccgccagccggttggtcgccatgtgatccgttattgtgacagcgtggtctgtcatatcaacggttatcagggtattcaggcggcgctcgagaaaaagctgaacatcaaaccagggcaaacgacatttgatggccgctttacgctgctgccaacttgctgcctggggaactgtgataaagggccaaacatgatgatcgatgaggacactcacgcgcatctgaccccggaagcgatccctgaactgctggagcggtataaatgaaaaacattatccgtactcccgaaacgcatccgctgacctggcgtctgcgcgatgacaaacagccagtgtggctggacgaataccgcagcaaaaacggttacgaaggcgcgcgtaaggcgctgaccgggctgtctccggacgaaatcgttaatcaggtaaaagacgctggtctgaaagggcgcggcggcgcgggcttctcgactggcctgaaatggagcctgatgccgaaagacgaatccatgaacatccgttacctgctgtgtaatgccgatgaaatggagccgggcacctataaagaccgcctgttgatggagcaactgccgcacctgctggtggaaggtatgctcatctccgcgtttgcgctgaaagcttaccgtggctacatcttcctgcgtggcgaatatatcgaagcggcagttaatctgcgccgtgccattgccgaagccaccgaagcgggtctgcttggcaaaaacattatgggaacaggtttcgatttcgaactgttcgtccataccggggcagggcgctacatctgcggggaagaaacagcgttaatcaactccctggaaggacgtcgtgctaacccacgctcgaagccacccttcccggcaacctccggcgcatggggtaaaccgacctgtgtcaacaacgtcgaaaccctgtgtaacgttccggcgatcctcgctaacggcgtggagtggtatcagaacatctcgaaaagtaaagatgctggcaccaagctgatgggcttctccggtcgggtgaaaaatccgggactgtgggaactgccgttcggcaccaccgcacgcgagatcctcgaagattacgccggtggtatgcgtgatggtctgaaatttaaagcctggcagccaggcggcgcggggactgacttcctgaccgaagcgcaccttgatctgccgatggaattcgaaagtatcggtaaagcgggcagccgtctgggtacggcgctggcgatggcggttgaccatgagatcaacatggtgtcgctggtgcgtaacctggaagagtttttcgcccgtgagtcctgcggctggtgtacgccgtgccgcgacggtctgccgtggagcgtgaaaattctgcgtgcgctggagcgtggtgaaggtcagccgggcgatatcgaaacacttgagcaactgtgtcgattcttaggcccgggtaaaactttctgtgcccacgcacctggtgcagtggagccgttacagagcgccatcaaatatttccgcgaagaatttgaggcgggaatcaaacagccgttcagcaatacccatttgattaatgggattcagccgaacctgctgaaagagcgctggtaaccgaatttcgattaacgctcagtctctgactgagaaaactggaagcatgctaatggctacaattcatgtagacggcaaagaatacgaggtcaacggagcggacaacctgctggaagcttgtctgtctctgggccttgatattccttacttttgctggcatccggcgctgggaagtgtcggtgcttgccgccagtgtgcggtgaagcaataccaaaacgcggaagacacgcgtggtcgcctggtgatgtcctgtatgacaccggcttccgatggcacctttatttccattgacgacgaagaagcgaaacagttccgtgaaagcgtggtcgagtggttgatgaccaaccacccgcacgactgtccggtatgtgaagagggcggtaactgccatcttcaggatatgactgtgatgaccggacacagcttccgtcgctaccgtttcaccaaacgtacccaccgtaatcaggatttggggccattcatctctcacgaaatgaaccgctgcatcgcctgctaccgctgtgtgcgttactacaaagattacgctgacggtacagatctgggcgtttacggtgcgcacgacaacgtctacttcggtcgcccggaagacggcacgctggaaagcgaattttccggtaacctggtcgaaatttgcccgaccggcgtatttaccgacaaaacgcactccgagcgttacaaccgtaaatgggatatgcagtttgcgccgagcatctgccagcaatgttccatcggctgtaacatcagccccggtgaacgttacggcgaactgcgtcgtatcgaaaaccgttacaacggtacggtaaaccactacttcctctgcgaccgtggtcgtttcggttacggttacgtcaacctgaaggatcgtccgcgtcagccagtacagcgtcgtggcgatgatttcattaccctcaacgccgaacaggcaatgcagggcgcggcagatattctgcgtcagtcgaagaaagtgatcggtattggttctccgcgtgccagcgtggaaagcaactttgcgctgcgtgaactggtgggcgaagaaaacttctacaccggtatcgctcacggtgagcaggaacgtctgcaactggcgctgaaagtgctgcgtgaaggcggcatttatactccggctctgcgcgaaatcgaatcttacgatgcggtactggtgctgggcgaagacgttacccagaccggcgcgcgcgtcgcgctggcagtgcgtcaggctgtgaaaggtaaagcgcgcgaaatggcggcagcacagaaagtggctgactggcagattgcggcaatcctcaacatcggtcaacgtgcgaagcatccgctgtttgttaccaacgttgatgacacccgtctggatgatatcgcggcgtggacttaccgcgcaccggttgaagatcaggcgcgtttaggttttgccatcgcccatgcgctggataactctgcaccagcggttgacggtatcgaacctgagctgcaaagcaaaatcgacgtcatcgtgcaggcactggcaggtgcgaagaaaccgttgattatctccgggacgaacgccggtagcttagaggtgattcaggcggcggctaacgtcgcgaaagccctgaaaggtcgcggcgctgacgtcggtatcaccatgattgcccgttccgtcaacagcatggggctgggcattatgggtggcggttcgcttgaagaagcgttaaccgaactggaaaccggacgcgccgacgcggtggtggtgttggaaaacgatctgcatcgtcacgcttctgctatccgcgtgaatgctgcgctggctaaagcaccgctggtgatggtggttgatcatcaacgcacagcgattatggaaaacgcccatctggtactttctgctgccagctttgctgaaagcgacggtacggtgatcaacaacgaaggccgcgcccaacgtttcttccaggtttacgatcctgcttattacgacagcaaaactgtcatgctggaaagctggcgctggttacactcgctgcacagcaccctgctgagccgtgaagtggactggacgcagctcgaccatgtgattgacgctgttgtggcgaaaatcccggaactggcaggtatcaaagatgctgcgccggatgcgacattccgtattcgtgggcagaaactggcccgtgaaccgcaccgttacagcggtcgtaccgccatgcgcgccaatatcagcgttcatgagccgcgtcagccgcaggatattgacaccatgttcaccttctcgatggaaggtaacaaccagccgactgcgcaccgttcgcaagtgccgtttgcctgggcgccgggctggaactccccgcaggcgtggaacaaattccaggacgaagtgggcggcaaactgcgctttggcgatccgggcgtgcgtctgtttgaaaccagcgaaaatggtctggattacttcaccagcgtaccggcacgcttccagccgcaggacgggaaatggcgtatcgcgccgtattaccacctgtttggcagcgatgaattgtcacagcgtgctccggtcttccagagccgtatgccgcagccgtacatcaaactcaacccagcggatgccgcgaagttgggtgtgaacgcaggtacacgcgtctcctttagttacgatggcaacacggtcacgctgccggttgaaatcgccgaaggactgacggcagggcaggtgggcttgccgatgggtatgtccggcattgctccggtgctggctggcgcgcatcttgaggatctcaaggaggcacaacaatgagttggatatcaccggaactgattgagatcctgctgaccatcctcaaagcggtggtgatcctgctggtggttgtcacctgcggggcattcatgagctttggcgaacgtcgcctgctgggtctgttccagaaccgttacggacctaaccgtgttggctggggcggttcgctccagctggttgcggacatgatcaaaatgttctttaaagaagactggatcccgaaattctcggatcgcgtcatctttaccctggcaccgatgattgcctttacctcgctgctgctggcctttgcgattgtgccagtcagtccgggttgggtggttgccgacctgaacatcgggattttgttcttcctgatgatggcaggtctggcggtttacgcggtgctgtttgcgggctggtcaagtaacaacaaatactcgttgctgggtgcgatgcgtgcttctgcgcagaccctgagctacgaagtgttcctcgggctttccttgatgggcgtggtggcgcaggccggttcattcaacatgaccgacatcgtcaacagccaggcgcatgtgtggaacgttatcccgcaattctttggttttattacctttgccatcgcgggcgtggcggtatgtcaccgtcacccgtttgaccagccggaagccgagcaggaactggcggatggttaccacattgaatattccggtatgaagttcggtctgttcttcgtgggtgagtacatcgggattgtgaccatctctgcattgatggtgacgctgttcttcggtggctggcaaggcccgttgttaccgccattcatctggttcgcgctgaaaaccgcgttctttatgatgatgttcattttgattcgtgcgtcgttaccgcgtccgcgttatgaccaggtaatgtccttcggctggaaaatctgcctgccgctgacgctgatcaacttgctggtaacggcggctgtcattctctggcaggcgcaataaggggcaataagaccatgaccttaaaagaattgttagtaggtttcggcacccaggttcgtagtatctggatgatcggcctgcacgcgttcgccaaacgcgaaacgcgaatgtacccggaagagccggtctatctgccgccccgttatcgtggtcgtatcgttctgacccgcgacccggacggcgaagagcgttgcgtagcctgtaacctctgcgcggtagcctgcccggtcggctgtatctcgctgcaaaaagcagaaaccaaagacggtcgctggtacccggaatttttccgcatcaacttctcacgctgcattttctgtggtctgtgcgaagaagcctgtccgaccacggcgattcagttaaccccggatttcgaaatgggggaatacaagcgccaggatctggtttacgagaaagaggatctgctgatctccggtccgggcaaatacccggaatataacttctaccggatggcaggtatggcaatcgacggcaaagataagggcgaagcagagaacgaagccaagcctatcgacgtcaagagcctgttaccgtaaggagaggggcaatggagttcgctttttatatctgtggcctgatagccatacttgcgaccttgcgagtgatcacccataccaatccggtacacgcactgctgtacctgattatttcgctgctggcgatttccggggtgttcttctcactgggcgcttacttcgccggtgcgctggaaattatcgtctacgcgggtgccattatggtgctgttcgtgttcgtggtgatgatgctcaacctgggcggttcagaaatcgaacaggaacgccagtggctgaaaccgcaggtgtggattggtccggcaattttgtcggccatcatgctggtggtgattgtttacgccatcctcggtgttaacgatcagggtatcgacggtacgccaatcagtgctaaagcagtgggtattacgctgttcgggccttacgtactggcggtggaactggcttctatgctgctgctcgcaggtctggttgtggccttccacgtcggtcgtgaagagcgtgcgggtgaagtgctgagcaatcgtaaagacgacagcgcgaaaagaaaaacggaggagcacgcatgatccccttacaacatggactgatcctcgcggcaatcttattcgttcttggcttaaccggtctggttatccgtcgcaatctgctgtttatgttgattggtctggaaatcatgattaacgcctccgcgctggccttcgtggtcgccggaagctactggggccagaccgacggtcaggtgatgtacattctcgccatcagcctcgcggcggcagaagcgagtatcggccttgcgctgctgctgcaacttcaccgtcgtcgccagaacctgaacatcgattcagtaagtgagatgcgcggatgaacatgcttgccttaaccattattttgccattgattggcttcgtcctgctggcattctcccgtgggcgctggtctgaaaacgtctcggcgatcgtcggcgtaggctctgtgggcctggcggcgctggtaaccgcctttatcggcgttgatttcttcgctaacggcgagcagacatacagccagccgctgtggacgtggatgtcggtaggcgactttaacatcggttttaacctggtgctggacggcctgtcgctgaccatgctctcggtggtcactggtgtgggtttccttattcacatgtacgcctcctggtatatgcgcggtgaagagggctactctcgcttcttcgcttacaccaacctgttcatcgccagcatggtggttctggtgcttgccgacaacctgctgctgatgtacctcggctgggaaggcgtgggcctgtgctcctatctgctgatcgggttctattacaccgatccgaagaatggcgcagcggcaatgaaagcgttcgtcgtgacccgtgtgggtgacgtgttcctcgctttcgcactgttcattctttacaacgaactgggcaccctgaacttccgcgaaatggtggaactggcaccagcgcactttgctgacggcaataacatgctgatgtgggcgacgctgatgctgctgggcggtgcggtcggtaaatctgcgcagttgccgttgcagacatggcttgccgacgcgatggcgggcccgacgcctgtctccgcgctgatccacgccgcaaccatggtaaccgcgggtgtctacctgatcgcccgtacccacggcctgttcctgatgacgccggaagttctgcatctggtgggtattgtcggggcggttacgctgctgctggccggttttgccgcgctggtacagaccgacatcaaacgtgttctcgcttactctaccatgagccagattggctacatgttcctcgcgcttggcgtgcaggcatgggatgcggcgattttccacttgatgacccacgcgttctttaaagcgctgctgttcctggcatccggttccgtcattctggcctgccatcacgaacagaacatcttcaagatgggcggtctgcgtaaatctattccgctggtttatctctgcttcctggtgggcggcgcagcactgtcggcactaccgctggtcactgcgggcttcttcagtaaggatgagatcctcgcgggtgcgatggcgaatggtcatatcaatctgatggtggcaggtctggtcggtgcgtttatgacctcgctctacaccttccgtatgattttcatcgtcttccacggaaaagaacaaattcacgctcacgccgtgaaaggggtaactcacagcctgccgctgattgtgctgctgatcctttccaccttcgttggcgcactgattgtaccgccgctgcagggcgtgcttccgcaaacgacggaactggcgcacggcagcatgttgaccctggaaattacctctggcgtggtcgcggtggtcggcattctgctggcagcctggctgtggctgggtaaacgtactctggtgacctccatcgccaacagtgcgccgggccgtctgctgggcacctggtggtacaacgcctggggatttgactggctgtatgacaaagtgttcgtcaagccgttcctgggtattgcctggttgctgaaacgcgatccgctgaactcaatgatgaacatcccggctgtcctttcccgctttgcaggtaaaggtctgctgttaagtgagaacggctatctgcgctggtatgtggcatccatgagcatcggtgcggtcgtggtgctggcactgttgatggtactgcgttgagttaaggattgtgggattgcccctgggcatataagaacgtaggtcggataagccgccttcgcggtgcatccgacactacccccagtccgaagagaattttctgtcgtgagaattcgttgaaaatccggtcctgacgggacttttacaaggaataaagatcgccatgttactaccctggctaatattaattccctttattggcggcttcctgtgctggcagaccgaacgctttggcgtcaaggtgccacgctggatcgcgctgatcaccatgggattgacgctggcgctgtcgctgcaactgtggttgcagggcggttattcactgacgcaatccgccggaattccgcagtggcagtctgaattcgacatgccgtggatcccgcgttttggtatctctattcatctcgccattgacgggctgtcgctgctgatggtcgtgctgaccggtctgctcggtgtgctggcggtactatgttcgtggaaagagatcgaaaaatatcagggcttcttccacctcaacctgatgtggatcctgggcggcgttatcggcgtgttccttgccatcgacatgttcctgttcttcttcttctgggaaatgatgctggtgccgatgtacttcctgatcgcactgtgggggcataaagcctctgacggtaaaacgcgtatcacggcggcaaccaagttcttcatttacacccaggcgagtggcctggtgatgttgattgccatcctggcgctggtttttgttcactacaatgcgaccggcgtctggaccttcaactatgaagagctgctgaatacgccaatgtccagtggtgtggaatacctgttaatgctgggcttcttcatcgccttcgcagtcaaaatgccggtggttccgctgcatggctggctgccggatgcgcactcccaggctccgaccgccggttccgttgacctcgcggggatcttgctgaaaactgccgcttacggtttgctgcgtttctccctgccgctgttcccgaacgcgtcggcagagttcgcgccaattgctatgtggctgggtgttatcggcatcttctacggtgcgtggatggccttcgcccagaccgatatcaaacgtctgatcgcctacacctcggtttcccacatgggcttcgtgctgattgctatctacaccggcagccagttggcctaccagggcgcggtaatccagatgattgcgcacggtttgtcggcggcgggtctgtttattctttgtggtcagctttatgaacgtatccatacccgcgacatgcgcatgatgggcggtctgtggagcaagatgaaatggctgccagcactgtcgctgttctttgcggtggcaacgcttgggatgcctggcaccggtaacttcgtcggcgaatttatgattctgttcggcagcttccaggttgtaccggtgattaccgttatctctacctttgggctggtctttgcatctgtttattcgctggcgatgttacatcgcgcttacttcggtaaagcgaaaagccagattgccagccaggaactgccagggatgtcgctgcgtgagctgtttatgatcctgttgctggtggtgctgctggtactgctgggcttctatccgcagccgattctggatacctcgcactccgcgattggcaatatccagcagtggtttgttaattccgttactactacaaggccgtaaatcgccatgacaataactccacaaaacctgatcgcactgctaccgttgctgatcgtcggcttgacggtggtggttgtgatgctctccattgcgtggcgacgcaatcatttcctcaacgctacgctctcggttattgggcttaacgcggcgctggtttcgctctggtttgttggccaggcgggcgctatggacgttacgccgctgatgcgcgttgatggtttcgccatgctttacaccgggctggtattgttggcgagcctcgccacctgtactttcgcctacccgtggcttgaaggctataacgacaacaaggatgagttctacctgttggtgttaattgccgcgctgggcgggatcctgctggcgaatgccaaccatctggcgtctctgttcctcggtatcgaactgatctctttgccgctgtttggcctggtcggttacgctttccgccagaaacgttcactggaagccagtatcaaatacaccatcctttctgccgcagcgtcttctttcctgctgtttggtatggcgctggtgtatgcgcagtctggcgacctgtcgtttgtcgcgttgggtaaaaaccttggcgacggtatgctcaacgagccgctgttgctggcaggtttcggcctgatgattgttggcctcggcttcaaactctctctggtgccgttccacctgtggacgccagacgtataccagggcgcgcctgcgccggtttccactttcctggcgacggcgagcaaaatcgctatcttcggtgtggtgatgcgtctgttcctctacgcaccggtgggtgacagcgaagcgattcgcgtggtgctggcgattatcgcctttgcctccatcatcttcggtaacctgatggcgctgagccagaccaatatcaaacgtctgctcggttactcatctatctctcacctcggctatctgctggtagcgctgattgcgctgcaaaccggcgagatgtcgatggaagcggtaggggtttacctggccggttatctgttcagcagcctcggcgcgttcggcgtggtcagcctgatgtccagcccgtatcgtggcccggatgctgattccctgttctcttaccgcggtctgttctggcatcgtccgatcctcgcggcagtgatgacggtgatgatgctgtctctggccggtatcccgatgacgctgggctttatcggtaagttctacgtgctggcggtcggtgtccaggcacacttgtggtggctggtgggtgccgtggttgtcggttcggcaatcggcctctactactacctgcgcgtggcggtgagcctgtatcttcacgccccggaacaaccgggtcgcgatgcaccatcaaactggcagtacagcgcgggcggtatcgttgtgctgatctctgcactgttggtactggtgctgggtgtatggccacaaccgctgattagcattgtgcgtttggcaatgccgctgatgtaatctgttactttgtaagtcagaaagccgccgacatgctcggcggtttttctgaaaaagaagggatagtagatagacgcagagcgttaagtgaactgtgtacgactatcgccaaaatactctaaacataactgcctgaattttgcccgccattcatcgatattaaaatcatagcgttcctgaaatgcagtcgtttcactggacattatccaggcataattatgtaacagggttaatgcctgaagcggttttctctgcgcaaaataagtatcaacacacatctgcatcaaggggtaattattattttcctttgttcctccaaagctaagatctaatccttgttctttaatgcactgaatcacaggatcatcctggaaattcgggacatctgcggcctgtgacagcaaatgaatgactttatt

SEQ ID NO: 2 - protein, 147 aa, Escherichia coli
MSMSTSTEVIAHHWAFAIFLIVAIGLCCLMLVGGWFLGGRARARSKNVPFESGIDSVGSARLRLSAKFYLVAMFFVIFDVEALYLFAWSTSIRESGWVGFVEAAIFIFVLLAGLVYLVRIGALDWTPARSRRERMNPETNSIANRQR

SEQ ID NO: 3 - protein, 220 aa, Escherichia coli
MDYTLTRIDPNGENDRYPLQKQEIVTDPLEQEVNKNVFMGKLNDMVNWGRKNSIWPYNFGLSCCYVEMVTSFTAVHDVARFGAEVLRASPRQADLMVVAGTCFTKMAPVIQRLYDQMLEPKWVISMGACANSGGMYDIYSVVQGVDKFIPVDVYIPGCPPRPEAYMQALMLLQESIGKERRPLSWVVGDQGVYRANMQSERERKRGERIAVTNLRTPDEI

SEQ ID NO: 4 - protein, 596 aa, Escherichia coli
MTDLTAQEPAWQTRDHLDDPVIGELRNRFGPDAFTVQATRTGVPVVWIKREQLLEVGDFLKKLPKPYVMLFDLHGMDERLRTHREGLPAADFSVFYHLISIDRNRDIMLKVALAENDLHVPTFTKLFPNANWYERETWDLFGITFDGHPNLRRIMMPQTWKGHPLRKDYPARATEFSPFELTKAKQDLEMEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALQNTILKGRSQGVAAYGAKEALEWGTTGAGLRATGIDFDVRKARPYSGYENFDFEIPVGGGVSDCYTRVMLKVEELRQSLRILEQCLNNMPEGPFKADHPLTTPPPKERTLQHIETLITHFLQVSWGPVMPANESFQMIEATKGINSYYLTSDGSTMSYRTRVRTPSFAHLQQIPAAIRGSLVSDLIVYLGSIDFVMSDVDR

SEQ ID NO: 5 - protein, 166 aa, Escherichia coli
MHENQQPQTEAFELSAAEREAIEHEMHHYEDPRAASIEALKIVQKQRGWVPDGAIHAIADVLGIPASDVEGVATFYSQIFRQPVGRHVIRYCDSVVCHINGYQGIQAALEKKLNIKPGQTTFDGRFTLLPTCCLGNCDKGPNMMIDEDTHAHLTPEAIPELLERYK

SEQ ID NO: 6 - protein, 445 aa, Escherichia coli
MKNIIRTPETHPLTWRLRDDKQPVWLDEYRSKNGYEGARKALTGLSPDEIVNQVKDAGLKGRGGAGFSTGLKWSLMPKDESMNIRYLLCNADEMEPGTYKDRLLMEQLPHLLVEGMLISAFALKAYRGYIFLRGEYIEAAVNLRRAIAEATEAGLLGKNIMGTGFDFELFVHTGAGRYICGEETALINSLEGRRANPRSKPPFPATSGAWGKPTCVNNVETLCNVPAILANGVEWYQNISKSKDAGTKLMGFSGRVKNPGLWELPFGTTAREILEDYAGGMRDGLKFKAWQPGGAGTDFLTEAHLDLPMEFESIGKAGSRLGTALAMAVDHEINMVSLVRNLEEFFARESCGWCTPCRDGLPWSVKILRALERGEGQPGDIETLEQLCRFLGPGKTFCAHAPGAVEPLQSAIKYFREEFEAGIKQPFSNTHLINGIQPNLLKERW

SEQ ID NO: 7 - protein, 908 aa, Escherichia coli
MATIHVDGKEYEVNGADNLLEACLSLGLDIPYFCWHPALGSVGACRQCAVKQYQNAEDTRGRLVMSCMTPASDGTFISIDDEEAKQFRESVVEWLMTNHPHDCPVCEEGGNCHLQDMTVMTGHSFRRYRFTKRTHRNQDLGPFISHEMNRCIACYRCVRYYKDYADGTDLGVYGAHDNVYFGRPEDGTLESEFSGNLVEICPTGVFTDKTHSERYNRKWDMQFAPSICQQCSIGCNISPGERYGELRRIENRYNGTVNHYFLCDRGRFGYGYVNLKDRPRQPVQRRGDDFITLNAEQAMQGAADILRQSKKVIGIGSPRASVESNFALRELVGEENFYTGIAHGEQERLQLALKVLREGGIYTPALREIESYDAVLVLGEDVTQTGARVALAVRQAVKGKAREMAAAQKVADWQIAAILNIGQRAKHPLFVTNVDDTRLDDIAAWTYRAPVEDQARLGFAIAHALDNSAPAVDGIEPELQSKIDVIVQALAGAKKPLIISGTNAGSLEVIQAAANVAKALKGRGADVGITMIARSVNSMGLGIMGGGSLEEALTELETGRADAVVVLENDLHRHASAIRVNAALAKAPLVMVVDHQRTAIMENAHLVLSAASFAESDGTVINNEGRAQRFFQVYDPAYYDSKTVMLESWRWLHSLHSTLLSREVDWTQLDHVIDAVVAKIPELAGIKDAAPDATFRIRGQKLAREPHRYSGRTAMRANISVHEPRQPQDIDTMFTFSMEGNNQPTAHRSQVPFAWAPGWNSPQAWNKFQDEVGGKLRFGDPGVRLFETSENGLDYFTSVPARFQPQDGKWRIAPYYHLFGSDELSQRAPVFQSRMPQPYIKLNPADAAKLGVNAGTRVSFSYDGNTVTLPVEIAEGLTAGQVGLPMGMSGIAPVLAGAHLEDLKEAQQ

SEQ ID NO: 8 - protein, 325 aa, Escherichia coli
MSWISPELIEILLTILKAVVILLVVVTCGAFMSFGERRLLGLFQNRYGPNRVGWGGSLQLVADMIKMFFKEDWIPKFSDRVIFTLAPMIAFTSLLLAFAIVPVSPGWVVADLNIGILFFLMMAGLAVYAVLFAGWSSNNKYSLLGAMRASAQTLSYEVFLGLSLMGVVAQAGSFNMTDIVNSQAHVWNVIPQFFGFITFAIAGVAVCHRHPFDQPEAEQELADGYHIEYSGMKFGLFFVGEYIGIVTISALMVTLFFGGWQGPLLPPFIWFALKTAFFMMMFILIRASLPRPRYDQVMSFGWKICLPLTLINLLVTAAVILWQAQ

SEQ ID NO: 9 - protein, 180 aa, Escherichia coli
MTLKELLVGFGTQVRSIWMIGLHAFAKRETRMYPEEPVYLPPRYRGRIVLTRDPDGEERCVACNLCAVACPVGCISLQKAETKDGRWYPEFFRINFSRCIFCGLCEEACPTTAIQLTPDFEMGEYKRQDLVYEKEDLLISGPGKYPEYNFYRMAGMAIDGKDKGEAENEAKPIDVKSLLP

SEQ ID NO: 10 - protein, 184 aa, Escherichia coli
MEFAFYICGLIAILATLRVITHTNPVHALLYLIISLLAISGVFFSLGAYFAGALEIIVYAGAIMVLFVFVVMMLNLGGSEIEQERQWLKPQVWIGPAILSAIMLVVIVYAILGVNDQGIDGTPISAKAVGITLFGPYVLAVELASMLLLAGLVVAFHVGREERAGEVLSNRKDDSAKRKTEEHA

SEQ ID NO: 11 - protein, 100 aa, Escherichia coli
MIPLQHGLILAAILFVLGLTGLVIRRNLLFMLIGLEIMINASALAFVVAGSYWGQTDGQVMYILAISLAAAEASIGLALLLQLHRRRQNLNIDSVSEMRG

SEQ ID NO: 12 - protein, 613 aa, Escherichia coli
MNMLALTIILPLIGFVLLAFSRGRWSENVSAIVGVGSVGLAALVTAFIGVDFFANGEQTYSQPLWTWMSVGDFNIGFNLVLDGLSLTMLSVVTGVGFLIHMYASWYMRGEEGYSRFFAYTNLFIASMVVLVLADNLLLMYLGWEGVGLCSYLLIGFYYTDPKNGAAAMKAFVVTRVGDVFLAFALFILYNELGTLNFREMVELAPAHFADGNNMLMWATLMLLGGAVGKSAQLPLQTWLADAMAGPTPVSALIHAATMVTAGVYLIARTHGLFLMTPEVLHLVGIVGAVTLLLAGFAALVQTDIKRVLAYSTMSQIGYMFLALGVQAWDAAIFHLMTHAFFKALLFLASGSVILACHHEQNIFKMGGLRKSIPLVYLCFLVGGAALSALPLVTAGFFSKDEILAGAMANGHINLMVAGLVGAFMTSLYTFRMIFIVFHGKEQIHAHAVKGVTHSLPLIVLLILSTFVGALIVPPLQGVLPQTTELAHGSMLTLEITSGVVAVVGILLAAWLWLGKRTLVTSIANSAPGRLLGTWWYNAWGFDWLYDKVFVKPFLGIAWLLKRDPLNSMMNIPAVLSRFAGKGLLLSENGYLRWYVASMSIGAVVVLALLMVLR

SEQ ID NO: 13 - protein, 509 aa, Escherichia coli
MLLPWLILIPFIGGFLCWQTERFGVKVPRWIALITMGLTLALSLQLWLQGGYSLTQSAGIPQWQSEFDMPWIPRFGISIHLAIDGLSLLMVVLTGLLGVLAVLCSWKEIEKYQGFFHLNLMWILGGVIGVFLAIDMFLFFFFWEMMLVPMYFLIALWGHKASDGKTRITAATKFFIYTQASGLVMLIAILALVFVHYNATGVWTFNYEELLNTPMSSGVEYLLMLGFFIAFAVKMPVVPLHGWLPDAHSQAPTAGSVDLAGILLKTAAYGLLRFSLPLFPNASAEFAPIAMWLGVIGIFYGAWMAFAQTDIKRLIAYTSVSHMGFVLIAIYTGSQLAYQGAVIQMIAHGLSAAGLFILCGQLYERIHTRDMRMMGGLWSKMKWLPALSLFFAVATLGMPGTGNFVGEFMILFGSFQVVPVITVISTFGLVFASVYSLAMLHRAYFGKAKSQIASQELPGMSLRELFMILLLVVLLVLLGFYPQPILDTSHSAIGNIQQWFVNSVTTTRP

SEQ ID NO: 14 - protein, 485 aa, Escherichia coli
MTITPQNLIALLPLLIVGLTVVVVMLSIAWRRNHFLNATLSVIGLNAALVSLWFVGQAGAMDVTPLMRVDGFAMLYTGLVLLASLATCTFAYPWLEGYNDNKDEFYLLVLIAALGGILLANANHLASLFLGIELISLPLFGLVGYAFRQKRSLEASIKYTILSAAASSFLLFGMALVYAQSGDLSFVALGKNLGDGMLNEPLLLAGFGLMIVGLGFKLSLVPFHLWTPDVYQGAPAPVSTFLATASKIAIFGVVMRLFLYAPVGDSEAIRVVLAIIAFASIIFGNLMALSQTNIKRLLGYSSISHLGYLLVALIALQTGEMSMEAVGVYLAGYLFSSLGAFGVVSLMSSPYRGPDADSLFSYRGLFWHRPILAAVMTVMMLSLAGIPMTLGFIGKFYVLAVGVQAHLWWLVGAVVVGSAIGLYYYLRVAVSLYLHAPEQPGRDAPSNWQYSAGGIVVLISALLVLVLGVWPQPLISIVRLAMPLM

SEQ ID NO: 15 - DNA, 15160 bp, Pantoea ananatis
atgagtatgtcaactaccaccgaaatcatcgctcagcattgggcattcgtcgtatttatcgtcatcgcttttggcctctgtgcgttcatgttaaccggaggctggctgcttggcggcagagcgcgtgcccgttacaaagacacaccttttgagtccggcattgaatccgtcggtgacactcacctccgcttatcagcaaaattctacctggtagcgatgttcttcgttatcttcgacgtagaagctctctttttatacgcatgggcgacctctatccgtgaaagcggctgggtcggctttgtggaagccgcaattttcattttggtgctcctggcgggcctggtttatctggtgcgcattggcgcgttggactggacgcctgcacgccggcgaatcgtggttaaaacgcctacggtaagtcacaccaatcctcataagcagtaaaagagaggcaataagatggactatacgctcacccgcatagacccaaacggtggtgagaacgaccgttaccctctgcaaaagcaggaaatcgtcagcgatccgctggagcagcacgttcatcgcagcgtctacatgggcaagctcgaacacgccctgcacgacatggtgaactggggacgtaaaaactccctgtggccttacaactttggtctttcatgctgctacgttgagatgaccacctccttcaccgccgtgcacgatgtcgcgcgtttcggtgcagaggttatgcgtgcatcgccacgtcaggccgacttcatggtcattgccggtacgccgtttaccaaaatggccccggtgattcagcgtttgtacgatcagatgctggagccgaaatgggtgatttccatgggtgcctgtgccaactcaggcggcatgtacgatatctattctgtcgtgcagggcgttgataagtttctgccggttgacgtgtatatcccgggttgcccgccgcgccctgaagcttacatgcaggcactgctgctgctgcaggaatccattggcaaagagcgccgtcccctttcgtgggtggtcggagaccagggcgtttaccgtgccaatatgcagtctgagcgtgaacgtaagcgtggcgaacgtattgcagtaaccaacctgcgtacaccagacgaagtttaagttaaccgtatggatggaatcagtgcctgcagcagacaacaccacaaattaatgcatggcaccatcctgacgccttcatttgagcgcctgttatcaggccggaatggtgagtaacgtatgacagatttgaccacgcaagatctcgctcagccgctatggcaaacccgggatcacctggatgacccggtgatcggcgagctgcgtaatcgttttgggccggatgcctttaccgttcaggcgacccgcaccggtattccggttgtttgggtaaagcgtgaacagctgctggaaatcattacattcctgcgaaaacttcctaagccgtacgtcatgctgtatgacctgcatggcatggacgaacgcttacgtacccaccgcgccggtttacctgccgcggatttttccgttttctaccacctactctcgattgaacgcaatcgcgacatcatgctcaaggtggctttatctgaaaacgatatgcatgtgccgaccatcaccaatattttcgccaatgccaactggtatgagcgcgaaacctgggagatgtttggtatcacctttgatggtcacccgcatctaacgcgcattatgatgccgcagacctgggaagggcatccgctgcgcaaggactatcctgcgcgtgcgaccgaattcgatcctttcacgctgacgaagcagaaagaagatctggaaatggaagcgctgacgttcaagccggaagactggggcatgaaacgcagcaccgccaacgaagatttcatgttcctcaacctcggtccaaaccacccgtcagcgcacggtgctttccgcatcattttgcagctggatggggaagagatcgtcgattgcgtcccggatattggttatcaccaccgtggcgcagagaaaatgggcgaacgtcagtcctggcacagctacattccttacaccgaccgtattgagtaccttggtggctgcgttaacgaaatgccttacgtactggccgttgagaaactggctggtatcgtggtgcctgaccgcgtgaatgttattcgcgtcatgctctctgagcttttccgcatcaacagtcacctgctgtacatctcgacctttattcaggacgttggcgcaatgacgccggtgttctttgcctttaccgaccgtcagaaaatttatgatgtggttgaggcgattaccggtttccgtatgcacccggcctggttccgtattggcggtgtggcacacgacctgccgaaaggctgggagcgcctgctgcgtgacttcctggactggatgccgaagcgcctgaaagagtatgacaaagcggcgctgcgcaacaccgttctgatgggccgttcgcaaggtgtggcagcctacaatatggaagaagcgctggcctggggcacaaccggtgctgccctgcgcgccaccggtctcgattttgacgtgcgtaaatggcgtccctattcaggctatgaaaacttcgacttcgaagtgcccgtgggtgccggtatcagcgatgcctacacgcgcgtacagctgaaaatggaagagatgtggcagtcgctgcgtattctggaacagtgcctgaacaacatgccggaagggccgtttaaagccgatcatccgctgacaaccccgccgccaaaagagcgcacgctgcagcacattgaaaccctgatcactcacttcctgcaggtgtcatggggcccggttatgccggccaatgaatccttccagatgattgaggcgaccaaagggattaacagttactacctgaccagtgatggcagcacgatgagttatcgcacacgtgtgcgtacgccgagcttcccgcacctgcagcagattccttcggtaatccgtggcagcctggtatccgatttaatcgtgtacctcggtagtatcgactttgttatgtcagacgtggaccgctaattatgcacgatcaacacattgctattaaaacgatcgaccctaacgaggtcttcgtgctgagtgcggaagagcaccatgcgattgagcacgaaaaacaccattacgaagatgcacgcgccgcgtcaattgaagcgctgaaaatcgtacagaaacaacgtggctgggtaccagacggcgcgattcatgcgattgccgacgttctgggcattcccgccagtgacgtagaaggtgtggcaacgttctacagccagattttccgccagccggttggccgccacgtgatccgctactgcgacagcgtggtctgtcacattaccggttttcagggcattcaggctgcgctggaagaaaacctcaatatcaagcccggccagaccacgaccgacggccgctttacgttgctgccgacctgctgtctgggtaactgcgataaaggcccaaccatgatggtggatgaagatacgcacgttcatctgacgccggaaggcatcgcctctttgctggagcagtatcaatgacaattaaacagatcattcgtactgccgaaacccatccactgacgtggcgcatgcgcgacgatcagcagccggtatggctggatgagtaccgcagcaaaaacggctacgccggtgcggaaaaagcactgaagggcatggcacccgacgagatcgtggcgctggtgaaagattccggcctgaagggacgcggtggtgcaggcttctctaccggtttgaagtggagcctgatgccgaaagacgaatccatgaacatccgttacctgctgtgtaacgccgatgaaatggagccgggcacctataaagaccgcctgttgatggagcagatgccgcatcagttggttgaaggcatgctgatcagtgcgtttgccctgaaagcctaccgtggctacatcttcctgcgtggcgaatacattgaagcggcggtgcatctgcgccgtgccatcgctgaagcgaccgaagccgggttactgggtaaaaatatcctgggctcagggttcgatttcgaactcatcgtccacaccggcgcaggccgctatatttgcggtgaagaaaccgcactgattaactcgctggaaggacgccgtgctaacccacgttctaagccgcctttcccggcgagcgcgggcgtttggggtaagccgacctgcgtgaacaacgttgaaactctgtcaaacgtgccggctattttggcaaacggcgttgagtggtatcagggtctgtctaagagcgacgatgcgggtaccaagctgatgggcttctcgggtcgggtgaaaaaccctggcgtctgggaactgccgttcggtatcacggcccgtgaaatcctggaagactatgccggcggcatgcgcgatggtctgcgctttaaagcgtggcagccgggcggggcgggaacggacttcctgacggaacagcatctggatctgccgatggagttcgccagcatcggtaaagcgggcagccgtctgggtacggcgctggccatggccgtggaccatgaaatcaatatggtttcactggtacgcaatctcgaagagttctttgcccgtgaatcctgcggctggtgtacgccatgccgcgatggtttgccgtggagcgtgaagatcctgcgcgcgctggagcagaaaaaaggccagccgggggatatcgaaaccctggagcagctttgccgccagctcggcccgggcaagacgttctgcgcccacgcacccggtgcagtcgaaccgctgcaaagcgccattaaatatttccgtgaagagtttgaagccggtatcgcgccgcaggtgtttggtaatacccgatcgatcggtggtattcagccaaacctgctgaaagcgcgctggtaattcgccgttatccacgggagctggccctgtgccgccgttcctgctgcagtgtgcaggaacaagaatttgattaacgctcgtctatgacgagccttacggaagcatgtcactatggctacaatccatgtagacggtaaagaatatgatgtgaacggagcggacaacctgctacaggcatgtctgtctctgggccttgatattccttatttttgctggcatccggcgctgggaagcgtgggtgcctgccgccaatgtgcggtaaagcaattccagaacgctgaagatacccgcggccgccttgtcatgtcctgtatgacgccggcgtctgacggcaccttcatctctattgatgatggcgaagcgaaagagttccgtgaaagcgtggttgagtggttaatgaccaaccacccgcacgactgtccggtatgcgaagagggcggtaactgtcatctgcaagatatgacggtaatgaccggccacagcttccgccgctatcgcttcaccaaacgcacccaccgtaatcaggaccttggcccgttcatttcgcatgagatgaaccgctgtatcgcctgctaccgctgtgtgcggtattacaaagattatgctgacggtaccgatctgggcgtttatggcgcgcatgacaacgtttacttcggccgcccggaagacggcacgctggaaagcgagttttccggcaacctggttgaagtctgcccaaccggcgtatttaccgataaaacccactctgaacgctataaccgtaaatgggatatgcagttcgcgcccagcatctgtcagcagtgcagcgtgggctgtaacaccagtccgggtgagcgctatggcgagctgcgccgcatcgaaaaccgttacaatggcagcgttaaccactacttcctgtgtgaccgtggtcgctttggttacggttacgtcaacctgaaggaccgccctcaccatccggtacagctgcgcggcagcgatcgcgtaacgctgaatgcggagcaggcggtgaacgtcggggcagacgtgctgcgccaggcgaaacgcgtgattggtatcggctcgccacgtgccagcgtcgagagcaactttgcgctgcgtgaactggtcggggccgaaaacttctctaccggtatgcctgccggtgagcaggaacgccttgaactgttgttaaaagtgctgcgtgacggcggaatttatacgccatcgctgcgtgaaattgaaagctacgatgcagtgctggtgctgggggaagatttgacccaggttggcgcgcgcgtggccctgtctgtgcgccaggctgtgaaaggtaaggcccgtgaaatggccgctgcgcagaaagtcgcagactggcaaatcgcggccatcatgaatatcggtcagcacgctaagcatccgctctttgtcaccaacgtcgatgaaacgcgtctcgatgatattgccgcgtggagctatcgtgccccagtggaagatcaggcgcgtcttggatttgccatcgccaatgcgctggacgaaaccgccccggccgtaagcgatttcgacgctgcgctgaacggcaagctggatgtcgtcgtgcaagcgctggccggcgctaaaaaaccgctgatcgtttccggtgttcactcaggcagcactgccatgattgaagcggccgcgaacgtggcgaaagcgctgaaagcgcgcggcgcagacgtcggtatcaccttactggcaggccatgcgaacagcatggggctgggcctgatgggcggaaacaccctggaccaggcgctagaacaactgcaaagcggcgaagccgatgcggtcgtggtactggaaaacgatctctatcgccatgcgccaaaagcgcaggtggatgcggcgctgaatcaagccgctaacgtgatcgtcgttgatcatcaacgcaccgccacgctggagaaagccggactggttttgtccgcggccagcttcgcggaaagcgacggcacctcaatcaaccacgaagggcgcgcacagcgtttcttccaggtgtacgatcctgcctattatgacaacagcatcgtgatgctggaaagctggcgctggttgcattcgctgcacagcgcgctggaaagccgccacgttgactggacgcagctggatcacgtcattgatgccgtggttgccagtctgccacagctgaagggaattaaagaggcggcaccggatgccagcttccgtatccgtggtcagaaactggcgcgttcaccgcatcgtgccagtggccgtaccgccgcgcgcgccaacatcagcgtgcacgagccgcgtcagccgcaggatcaggacacgatgtttgccttctcaatggaagggaacaaccagccgaacgcaccgcgttcgcagatcccctttgcctgggcgccaggctggaactcacctcaggcatggaacaaattccaggatgaagtgggcggtaaactgcgtcacggcgatcccggcgtgcgtctgttcgaagccagcgacgcacagttagcctggttcagcagcgtacctggcgcgtataccactaacggtcagttccgcgtcgcgccttactatcagctattcggtagtgaagagatgacgcagcgcgcgccggtgatccaacagcgtatgtcggcacccactctggtcctgaacccggaggatgcggctaagctgggcgtgaacagtggcgcgtctgtggaattaacctgtgccggtgaaaccgtacgcttgcctgtgcttttctccgcgtcgctgcaggcagggcaggtggggcttccactcggtctgccgggcgtaccgccattcctggcgaatgcaaaaattgattctctgcaggaggcggcgcaatgagctggttaactccaggtgttatcgacattctgatcgccgtgggtaaagcgctggtgattctgctggtcgtggtgggctgcggtgcgtttatgagcttcgccgagcgtcgtctgctcggcctgttccagaaccgctatggaccgaaccgcgtgggctggggcggatccttgcagctggttgctgacatgatcaagatgttctttaaagaggactgggttcccccgttcaccgaccgctttatctttaccctggcgccggtcatcgccttcgtgtcactgctgctggcatttgccatcgtgccggtttcgccgacctgggtcgtcaccgacctgaacatcgggctgctgttcttcctgatgatggcgggcctggcggtctatgccgtactgtttgccggctgggcgagtaataacaaatactcgctgttaggtgccatgcgcgcctctgcgcagacgctgagttacgaagtgtttctgggactgtcgctgatgggcgtagtggcgcaggcgggatcgttcaacatgaccgatatcgtcaacagccagacgcacctgtggaacatcatcccgcagttctttggttttctgaccttctgtattgcgggcgtcgcggtctgtcaccgtcatccttttgaccagccagaagctgagcaagagctggccgacggttaccacattgaatatgccgggatgaaattcggcctgttctttgtgggcgaatacgtcgcgattaccaccgtctcagcactgattgtgacgctgttcttcgggggctggcatgggcctttcctgccgcctttcatctggttcgccctgaaaacggcgttctttatgatgatgttcatcctgattcgtgctgcgcttccgcgtccacgctatgaccaggtgctgtcgttcggctggaaagtgtgtctgccgttgacgctgttgaacctgctggcgaccgccgcagtgattctgtacacagcgcagtaaggggtaaacaaatgacattaaaagatattgtcgtaggcttcggcacgacagttcgcagtatctggatgataggcatgcacgccttcgcgaaacgcgaaacccagatgtatccggaagagccagtctacctgccaccgcgctatcgtggtcgtatcgttttgacgcgcgatcccgatggggcagagcgttgcgttgcctgtaacctgtgtgcagtagcctgtccggtaggctgtatttcactgcaaaaggccgaaaccaaagacggtcgctggtatccagagttcttccgtattaacttctcacgctgcattttctgcggcctgtgcgaagaggcctgcccaaccaccgctatccagctgacgccggatttcgagctgggcgagttcaagcgtcaggatctggtgtatgaaaaagacgatctgttgatctcggggccgggtaaatatccggagtacaacttctaccgcatggcaggtatggcgattgacggtaaagataaaggtgacgctgaaaatgaagcgaaacccatcgacgtcaaaggcttattaccttaaggagcaaggcatggaatttgcgttttatctttgcggactggtggcggtggtgacgacgttacgcgtcattacccacactaatccggtacatgcgttgctgtacctgatcgtttcgctgttatcggtggcgggtgtctttttctccctgggtgcctactttgccggtgcgctggaaatcatcgtgtatgccggtgccatcatggtgctgttcgtgttcgtcgtgatgatgctcaacctgggcaaggccacggagaaacaggaacgcgaatggctcagcccgtccctgtggatcggtcccggtctggtgtcctttctgctactggcggtcatgatttacgccatcatgacggcacaggatcagggcattgacggtaaaatcatcgacgcgaaagcggtcggtattagcctgtttggcccgtatgtcctggcggttgaactggcatcaatgctgctgttggccggtctggttgttgccttccatctgggacgtgaagagcgccagggtgaagtcctgagcaaccgttcaaacgatgccgcgcaggcgaataaggagcaagcatgatcccgttacaacatggattgattttggccgcggtgctgttcgttcttggcctgacctcgctggtactgcgccgcaacctgctgtttatgctgatcagccttgaaattatgatcaacgccgcggcgctggcgctggtcgtcgcgggcagctactggggacaggccgatggtcaggtgatgtatattctggcaatcagcctcgccgcagcggaagccagtatcggtctggccctgctgcttcagctctatcgtcgtcgtcagacgctgaacattgatattgtgagcgagatgcgcggatgaaccttctctatttaactgtcttgtttccgctgatcggctttttgctgttagcgttttcccgtggtcgctggtcagagaatctgtcggcgacggtcggaatgggatcggtggggttagccgcactgaccaccctgtatgttggcgttgacttctttgctaacgggcagcaggtattcacccaggcgctgtggacctggattcacgtgggcaattttaacattcaggtcaatctgactctggatggcctctcgcttaccatgctgtcggtggttaccggcgtcggtttcctgatccatatgttcgcctcctggtatatgcgcggagaagagggctattcacgcttcttcgcctataccaacctgtttatcgccagcatggtggttctggtgctggcggataacctgatgctgatgtatctgggctgggaaggggttgggctgtgttcttacctcctgatcggcttctactacagcaatccggaaaacggcaaagcggcgatgaaagcctttatcatcacccgcgtcggcgatgtgtttctggcctttgcgctgttcatcctttacaacgaactgggtacgctcaacttccgcgagatggttgagctggcaccggcacactttgcggcggacaatcacatgctgcagtgggctaccctgatgctgttaggcggtgcggtcggtaaatcggcccagttgcccttacagacctggctggccgatgcaatggcaggcccgacaccggtatcggcactgattcacgccgcgaccatggtaacggcaggggtttacctgattgcccgcacgcatggcctgttcctgctgacgcctgaggtgctgcatctggtcggcattatcggtgccattaccctggtgctggcaggctttgctgccctggttcagacggacatcaaacgcgttctcgcttactccaccatgagccagattggctacatgttcctggcgctgggcgtacaggcgtgggatgccgcgattttccacctgatgacccacgccttctttaaagccttgctgttcctgtcttcaggttcggttattctggcctgccaccacgagcagaacatctttaagatgggcggactgcgtaagagcatcccgctggtttacacctgcttcctggtgggcggcgccgcgctggcggcactgccactgattaccgccggtttctacagtaaagatgaaatcctgtttggtgcgctggcgaacggtcatcttaacctgatggtagcgggcctggtgggtgcgttcctgacctcaatttataccttccgcatgatcttcatcgtgttccacggtgaagagaagattcatgctcatgcgggtaaaggcattacccatcatctgccgctgctggtgctgctggtgctttctaccttcgttggcgcactgattaccccaccactggcgggcgttttgccggcgaatgagtttggcgaaaacggtaaagtgacgctggagattgcatcgggtctggtcgcggtttccggcatcgtgattgcagccgcactttggctgggcaaacgtcagttggtgacccgtattgccaacagcgcaccgggccgtttcttcggcacctggtggttcgctgcctggggcttcgactggctctacgacaaggtgtttgtcaaaccgtacctgggcattgcgtggctgttaaaacgcgatccgctcaacggcctgatgaacctccctgcgttgctttcacgtatcgccaataaaggtctggtggtcagtgaaaacggttatctgcgctggtacgtggcgtcgatgagcgtgggtgccgtcgtggttctggccctgttgctggtaatttaaagattgatgagcggggtgagttcgcttaccccagttaagaatgtccaaataaccgagtaatgagcgcaatcgtcgcagccagtttcattatcgccagcgcacagcaaccggagcgtactgaagtacgtgaggattgcgagcactgccgggaatgaaaatggtaagtaagatagctcataaaaggccataaaagggaagtatgccgtgttattaccttggctaattttcatacccttcttcggtggttttatctgctggctcgccgagcgcttcggcgcgaaagtgccacgctggattgcactgatcaccatggggctgacgttggcgctttcactgcagctttggttgcagggaggctattcactgacgcaggcagcgggtattccgcagtggcaatcgagcttctcagtaccctggatcccccgtttcggcattaatttccatttagcgcttgatggcctttcgctattaatggtggtgctgaccgggctgctcggtttgatggccgtgctgtgttcgtggaacgagatcgagaagtatcagggattcttccatcttaacctgatgtggattctgggcggcgttattggtgtgttccttgccatcgacatgttcctgttcttcttcttctgggaaatgatgctggtgccgatgtacttcctcatcgcactgtggggacataaagcctcggacgggaaaacccgtatcaccgcggccaccaaattctttatctatacccaggcatcaggtctggtgatgttaattgcgattctggcgctggtgtttgtccactacaacgcgaccggcgtctggacgttcaactacgagcagttgttgaaaacgcccatgtcgcacaccgtcgaatatctgctgatgctgggcttctttatcgcgtttgcggtgaaaatgccggtggtgccgcttcatggctggttacccgatgcgcacagtcaggcgccgacggccggttcagtggacctggcgggtattttgctgaaaactgcggcctatggtttgctgcgtttcagcctgccgctgttccccaatgcatccgctgagtttgcccctatcgcgatgtggttaggtatcatcggtatcttctacggcgcctggatggcgttctcgcagacggatattaaacgcctgattgcctacacctcgatttcccacatgggctttgtgctgattgcgatttacaccggcagccagctggccattcagggcgcggtgatacagatgattgcgcacggcctgtctgcggcggccctgtttatcctgtgtggtcagctgtatgagcgcctgcacacgcgtgatatgcgtcagatgggcggtctgtggtcgcgcatcaaatggattccgggtttatcactgttctttgctgtcgccaacctggggatgccgggcaccggtaacttcgtgggtgagtttatgatcctcaccggcagcttccaggtcgttcctgtcattattgtgattgcgacctttggtctggttttcgcttcggtttattcgctggtcatgatgcagcgtgcctactacggcgaagcgaaatctaaagatccactgccaggaatgtcggcacgtgaattcctgaccattggcgtgctcgtggttctgctggtgctgttgggtatttatccccagccgattctggatacctcacatgctgcaatgagcaatattcagcagtggtttaccgcttcaatttcaactacaaggccgtaattcgccatgacaataactcctcaacaattgatcgcgttgctgccgctgttaatcgtcggattgacggtggtggttgtgatgctgtccattgcctggcgacgcaaccactttgttaacgccacgctaacagtggttggcctgaacctggctctgctgtcgctgtattttgtgggccaggtcggggcgatggacgtcacgccgctgctgcgcgttgatgcttactcgatgttctataccgcactggtgatgctggccagcctggcaacctgtacgtttgcctatccatggctggcgactttcccggataacaaggacgagttttatctgttggtcctgattgccgcactgggcggtatcgtgctgtcagcgtctaaccacctggcatcgctgtttatcggaattgaactgctgtcactgccgctgtttggtttgattggttacgcattccgccagaaacgttcgctggaagcggccctgaaatacactatcctgtcggcggcggcatcgtccttcctgctgtttggtattgcgctgatttacgctgactctggcaacctgggcttcgtcagcctgggcaaaagcctgactgacagcatgattcaggcgccactgttgctggtgggcctgggaatgctgattattggtctgggctttaagctgtcgctggtgccgttccacctgtggacgccagacgtgtatcagggggcaccggctccggtatcaacgttcctggccacggccagtaaaatcgccatcttcggtgtcgtcatgcgcttgttcatgtatgcgccggtgaccgacagcgaagcggtgcgaacggtattgggtatcatcgccttcgtttccatcctgttcggtaacctgatggcgatctcgcagagcaacattaagcgcctgttgggttactcctccatcgcgcatctgggttatttgctggtggcgctgattgcggtgaaagatcatcagctgtcgctggaaacctctggggtttacctggccggttacctgttcagcagcctgggtgcctttggtgtcgtgagcctgatgtcgagcccttatcgcggtccggatgcggattcactctactcatatcgcggtctgttctggcgtcgtccggttctctctgcggtgatgacggtgatgatgctgtcgctggccggtattccaatgacgctgggctttatcggtaagttctacgtgattgcctctggcgtgagtgcgcacctgtggtggttgaccggtgcggtggtggtggggagtgctatcggcctgtactactatctgcgcgtgaccgtgagcctgtacctgagcccaccagaactgcttaaccgtgatacgcctgataactgggccttcaccgcgggcggcgtggtggtactgatttcagcgattctggtactgctgttaggtgtttatccgcagccgttaatcagactggtacagatggctcagcccctgatgtaa

SEQ ID NO: 16 - protein, 147 aa, Pantoea ananatis
MSMSTTTEIIAQHWAFVVFIVIAFGLCAFMLTGGWLLGGRARARYKDTPFESGIESVGDTHLRLSAKFYLVAMFFVIFDVEALFLYAWATSIRESGWVGFVEAAIFILVLLAGLVYLVRIGALDWTPARRRIVVKTPTVSHTNPHKQ

SEQ ID NO: 17 - protein, 225 aa, Pantoea ananatis
MDYTLTRIDPNGGENDRYPLQKQEIVSDPLEQHVHRSVYMGKLEHALHDMVNWGRKNSLWPYNFGLSCCYVEMTTSFTAVHDVARFGAEVMRASPRQADFMVIAGTPFTKMAPVIQRLYDQMLEPKWVISMGACANSGGMYDIYSVVQGVDKFLPVDVYIPGCPPRPEAYMQALLLLQESIGKERRPLSWVVGDQGVYRANMQSERERKRGERIAVTNLRTPDEV

SEQ ID NO: 18 - protein, 599 aa, Pantoea ananatis
MTDLTTQDLAQPLWQTRDHLDDPVIGELRNRFGPDAFTVQATRTGIPVVWVKREQLLEIITFLRKLPKPYVMLYDLHGMDERLRTHRAGLPAADFSVFYHLLSIERNRDIMLKVALSENDMHVPTITNIFANANWYERETWEMFGITFDGHPHLTRIMMPQTWEGHPLRKDYPARATEFDPFTLTKQKEDLEMEALTFKPEDWGMKRSTANEDFMFLNLGPNHPSAHGAFRIILQLDGEEIVDCVPDIGYHHRGAEKMGERQSWHSYIPYTDRIEYLGGCVNEMPYVLAVEKLAGIVVPDRVNVIRVMLSELFRINSHLLYISTFIQDVGAMTPVFFAFTDRQKIYDVVEAITGFRMHPAWFRIGGVAHDLPKGWERLLRDFLDWMPKRLKEYDKAALRNTVLMGRSQGVAAYNMEEALAWGTTGAALRATGLDFDVRKWRPYSGYENFDFEVPVGAGISDAYTRVQLKMEEMWQSLRILEQCLNNMPEGPFKADHPLTTPPPKERTLQHIETLITHFLQVSWGPVMPANESFQMIEATKGINSYYLTSDGSTMSYRTRVRTPSFPHLQQIPSVIRGSLVSDLIVYLGSIDFVMSDVDR

SEQ ID NO: 19 - protein, 171 aa, Pantoea ananatis
MHDQHIAIKTIDPNEVFVLSAEEHHAIEHEKHHYEDARAASIEALKIVQKQRGWVPDGAIHAIADVLGIPASDVEGVATFYSQIFRQPVGRHVIRYCDSVVCHITGFQGIQAALEENLNIKPGQTTTDGRFTLLPTCCLGNCDKGPTMMVDEDTHVHLTPEGIASLLEQYQ

SEQ ID NO: 20 - protein, 448 aa, Pantoea ananatis
MTIKQIIRTAETHPLTWRMRDDQQPVWLDEYRSKNGYAGAEKALKGMAPDEIVALVKDSGLKGRGGAGFSTGLKWSLMPKDESMNIRYLLCNADEMEPGTYKDRLLMEQMPHQLVEGMLISAFALKAYRGYIFLRGEYIEAAVHLRRAIAEATEAGLLGKNILGSGFDFELIVHTGAGRYICGEETALINSLEGRRANPRSKPPFPASAGVWGKPTCVNNVETLSNVPAILANGVEWYQGLSKSDDAGTKLMGFSGRVKNPGVWELPFGITAREILEDYAGGMRDGLRFKAWQPGGAGTDFLTEQHLDLPMEFASIGKAGSRLGTALAMAVDHEINMVSLVRNLEEFFARESCGWCTPCRDGLPWSVKILRALEQKKGQPGDIETLEQLCRQLGPGKTFCAHAPGAVEPLQSAIKYFREEFEAGIAPQVFGNTRSIGGIQPNLLKARW

SEQ ID NO: 21 - protein, 907 aa, Pantoea ananatis
MATIHVDGKEYDVNGADNLLQACLSLGLDIPYFCWHPALGSVGACRQCAVKQFQNAEDTRGRLVMSCMTPASDGTFISIDDGEAKEFRESVVEWLMTNHPHDCPVCEEGGNCHLQDMTVMTGHSFRRYRFTKRTHRNQDLGPFISHEMNRCIACYRCVRYYKDYADGTDLGVYGAHDNVYFGRPEDGTLESEFSGNLVEVCPTGVFTDKTHSERYNRKWDMQFAPSICQQCSVGCNTSPGERYGELRRIENRYNGSVNHYFLCDRGRFGYGYVNLKDRPHHPVQLRGSDRVTLNAEQAVNVGADVLRQAKRVIGIGSPRASVESNFALRELVGAENFSTGMPAGEQERLELLLKVLRDGGIYTPSLREIESYDAVLVLGEDLTQVGARVALSVRQAVKGKAREMAAAQKVADWQIAAIMNIGQHAKHPLFVTNVDETRLDDIAAWSYRAPVEDQARLGFAIANALDETAPAVSDFDAALNGKLDVVVQALAGAKKPLIVSGVHSGSTAMIEAAANVAKALKARGADVGITLLAGHANSMGLGLMGGNTLDQALEQLQSGEADAVVVLENDLYRHAPKAQVDAALNQAANVIVVDHQRTATLEKAGLVLSAASFAESDGTSINHEGRAQRFFQVYDPAYYDNSIVMLESWRWLHSLHSALESRHVDWTQLDHVIDAVVASLPQLKGIKEAAPDASFRIRGQKLARSPHRASGRTAARANISVHEPRQPQDQDTMFAFSMEGNNQPNAPRSQIPFAWAPGWNSPQAWNKFQDEVGGKLRHGDPGVRLFEASDAQLAWFSSVPGAYTTNGQFRVAPYYQLFGSEEMTQRAPVIQQRMSAPTLVLNPEDAAKLGVNSGASVELTCAGETVRLPVLFSASLQAGQVGLPLGLPGVPPFLANAKIDSLQEAAQ

SEQ ID NO: 22 - protein, 325 aa, Pantoea ananatis
MSWLTPGVIDILIAVGKALVILLVVVGCGAFMSFAERRLLGLFQNRYGPNRVGWGGSLQLVADMIKMFFKEDWVPPFTDRFIFTLAPVIAFVSLLLAFAIVPVSPTWVVTDLNIGLLFFLMMAGLAVYAVLFAGWASNNKYSLLGAMRASAQTLSYEVFLGLSLMGVVAQAGSFNMTDIVNSQTHLWNIIPQFFGFLTFCIAGVAVCHRHPFDQPEAEQELADGYHIEYAGMKFGLFFVGEYVAITTVSALIVTLFFGGWHGPFLPPFIWFALKTAFFMMMFILIRAALPRPRYDQVLSFGWKVCLPLTLLNLLATAAVILYTAQ

SEQ ID NO: 23 - protein, 180 aa, Pantoea ananatis
MTLKDIVVGFGTTVRSIWMIGMHAFAKRETQMYPEEPVYLPPRYRGRIVLTRDPDGAERCVACNLCAVACPVGCISLQKAETKDGRWYPEFFRINFSRCIFCGLCEEACPTTAIQLTPDFELGEFKRQDLVYEKDDLLISGPGKYPEYNFYRMAGMAIDGKDKGDAENEAKPIDVKGLLP

SEQ ID NO: 24 - protein, 200 aa, Pantoea ananatis
MKRNPSTSKAYYLKEQGMEFAFYLCGLVAVVTTLRVITHTNPVHALLYLIVSLLSVAGVFFSLGAYFAGALEIIVYAGAIMVLFVFVVMMLNLGKATEKQEREWLSPSLWIGPGLVSFLLLAVMIYAIMTAQDQGIDGKIIDAKAVGISLFGPYVLAVELASMLLLAGLVVAFHLGREERQGEVLSNRSNDAAQANKEQA

SEQ ID NO: 25 - protein, 100 aa, Pantoea ananatis
MIPLQHGLILAAVLFVLGLTSLVLRRNLLFMLISLEIMINAAALALVVAGSYWGQADGQVMYILAISLAAAEASIGLALLLQLYRRRQTLNIDIVSEMRG

SEQ ID NO: 26 - protein, 611 aa, Pantoea ananatis
MNLLYLTVLFPLIGFLLLAFSRGRWSENLSATVGMGSVGLAALTTLYVGVDFFANGQQVFTQALWTWIHVGNFNIQVNLTLDGLSLTMLSVVTGVGFLIHMFASWYMRGEEGYSRFFAYTNLFIASMVVLVLADNLMLMYLGWEGVGLCSYLLIGFYYSNPENGKAAMKAFIITRVGDVFLAFALFILYNELGTLNFREMVELAPAHFAADNHMLQWATLMLLGGAVGKSAQLPLQTWLADAMAGPTPVSALIHAATMVTAGVYLIARTHGLFLLTPEVLHLVGIIGAITLVLAGFAALVQTDIKRVLAYSTMSQIGYMFLALGVQAWDAAIFHLMTHAFFKALLFLSSGSVILACHHEQNIFKMGGLRKSIPLVYTCFLVGGAALAALPLITAGFYSKDEILFGALANGHLNLMVAGLVGAFLTSIYTFRMIFIVFHGEEKIHAHAGKGITHHLPLLVLLVLSTFVGALITPPLAGVLPANEFGENGKVTLEIASGLVAVSGIVIAAALWLGKRQLVTRIANSAPGRFFGTWWFAAWGFDWLYDKVFVKPYLGIAWLLKRDPLNGLMNLPALLSRIANKGLVVSENGYLRWYVASMSVGAVVVLALLLVI

SEQ ID NO: 27 - protein, 471 aa, Pantoea ananatis
MGLTLALSLQLWLQGGYSLTQAAGIPQWQSSFSVPWIPRFGINFHLALDGLSLLMVVLTGLLGLMAVLCSWNEIEKYQGFFHLNLMWILGGVIGVFLAIDMFLFFFFWEMMLVPMYFLIALWGHKASDGKTRITAATKFFIYTQASGLVMLIAILALVFVHYNATGVWTFNYEQLLKTPMSHTVEYLLMLGFFIAFAVKMPVVPLHGWLPDAHSQAPTAGSVDLAGILLKTAAYGLLRFSLPLFPNASAEFAPIAMWLGIIGIFYGAWMAFSQTDIKRLIAYTSISHMGFVLIAIYTGSQLAIQGAVIQMIAHGLSAAALFILCGQLYERLHTRDMRQMGGLWSRIKWIPGLSLFFAVANLGMPGTGNFVGEFMILTGSFQVVPVIIVIATFGLVFASVYSLVMMQRAYYGEAKSKDPLPGMSAREFLTIGVLVVLLVLLGIYPQPILDTSHAAMSNIQQWFTASISTTRP

SEQ ID NO: 28 - protein, 485 aa, Pantoea ananatis
MTITPQQLIALLPLLIVGLTVVVVMLSIAWRRNHFVNATLTVVGLNLALLSLYFVGQVGAMDVTPLLRVDAYSMFYTALVMLASLATCTFAYPWLATFPDNKDEFYLLVLIAALGGIVLSASNHLASLFIGIELLSLPLFGLIGYAFRQKRSLEAALKYTILSAAASSFLLFGIALIYADSGNLGFVSLGKSLTDSMIQAPLLLVGLGMLIIGLGFKLSLVPFHLWTPDVYQGAPAPVSTFLATASKIAIFGVVMRLFMYAPVTDSEAVRTVLGIIAFVSILFGNLMAISQSNIKRLLGYSSIAHLGYLLVALIAVKDHQLSLETSGVYLAGYLFSSLGAFGVVSLMSSPYRGPDADSLYSYRGLFWRRPVLSAVMTVMMLSLAGIPMTLGFIGKFYVIASGVSAHLWWLTGAVVVGSAIGLYYYLRVTVSLYLSPPELLNRDTPDNWAFTAGGVVVLISAILVLLLGVYPQPLIRLVQMAQPLM

SEQ ID NO: 29 - DNA, 1305 bp, Escherichia coli
  CDS (1)..(1305)
ttgactacgccattgaaaaagattgtgattgtcggcggcggtgctggtgggctggaaatggcaacacagctggggcataagctgggacgcaagaaaaaagccaaaattacgctggtcgatcgtaaccacagccacctgtggaaaccgctgctgcacgaagtggcgactggctcgcttgatgaaggcgtcgatgcgttgagctatctggcccatgcgcgcaatcatggtttccagttccagctgggttccgtcattgatattgatcgtgaagcgaaaacaatcactattgcagaactgcgcgacgagaaaggtgaactgctggttccggaacgtaaaatcgcctatgacaccctggtaatggcgctgggtagcacctctaacgatttcaatacgccaggtgtcaaagagaactgcattttcctcgataacccgcaccaggcgcgtcgcttccaccaggagatgctgaatttgttcctgaaatactccgccaacctgggcgcgaatggcaaagtgaacattgcgattgtcggcggcggcgcgacgggtgtagaactctccgctgaattgcacaacgcggtcaagcaactgcacagctacggttacaaaggcctgaccaacgaagccctgaacgtaacgctggtagaagcgggagaacgtattttgcctgcgttaccgccacgtatctctgctgcggcccacaacgagctaacgaaacttggcgttcgcgtgctgacgcaaaccatggtcaccagtgctgatgaaggcggcctgcacactaaagatggcgaatatattgaggctgatctgatggtatgggcagccgggatcaaagcgccagacttcctgaaagatatcggtggtcttgaaactaaccgtatcaaccagctggtggtggaaccgacgctgcaaaccacccgcgatccagacatttacgctattggcgactgcgcgtcatgcccgcgtccggaagggggctttgttccgccgcgtgctcaggctgcacaccagatggcgacttgcgcaatgaacaacattctggcgcagatgaacggtaagccgctgaaaaattatcagtataaagatcatggttcgctggtatcgctgtcgaacttctccaccgtcggtagcctgatgggtaacctgacgcgcggctcaatgatgattgaaggacgaattgcgcgctttgtatatatctcgctataccgaatgcatcagattgcgctgcatggttactttaaaaccggattaatgatgctggtggggagtattaaccgcgttatccgtccgcgtttgaagttgcattaa

SEQ ID NO: 30 - protein, 434 aa, Escherichia coli
MTTPLKKIVIVGGGAGGLEMATQLGHKLGRKKKAKITLVDRNHSHLWKPLLHEVATGSLDEGVDALSYLAHARNHGFQFQLGSVIDIDREAKTITIAELRDEKGELLVPERKIAYDTLVMALGSTSNDFNTPGVKENCIFLDNPHQARRFHQEMLNLFLKYSANLGANGKVNIAIVGGGATGVELSAELHNAVKQLHSYGYKGLTNEALNVTLVEAGERILPALPPRISAAAHNELTKLGVRVLTQTMVTSADEGGLHTKDGEYIEADLMVWAAGIKAPDFLKDIGGLETNRINQLVVEPTLQTTRDPDIYAIGDCASCPRPEGGFVPPRAQAAHQMATCAMNNILAQMNGKPLKNYQYKDHGSLVSLSNFSTVGSLMGNLTRGSMMIEGRIARFVYISLYRMHQIALHGYFKTGLMMLVGSINRVIRPRLKLH

SEQ ID NO: 31 - DNA, 1248 bp, Pantoea ananatis
  CDS (1)..(1248)
atggcaacgcagttaggccataagctgggtcgcaagaagaaagccgagattatcctggttgaccgcaaccacagccatctgtggaagccgttgctgcatgaagtggccaccggctccatggatgaaggcattgacgccctcagctatctggcgcatgcccgcaaccacggttttcagttccaactgggctcgttgacgaacatcaaccgtgagaaaaaagtcatccaactggctgaagtcgtgaattcgcagggggaggtattggttcccgagcgcgagctggcttatgacacgctggtcatggcgctgggcagtacctcaaacgatttcggcacgccaggcgttaaagatcactgtattttcctcgacaatccgcagcaggcgcgtcgtttccataatgaaatgctgaatctgttcctgaaattctctgccagcgaaggggcggtggagaaggtgaacattgctatcgtcggcggcggtgcaacgggtgttgagctgtcggcagaactgcacaatgcagttaagcagctacacagctacgggtataaagcactgggcagcgaggcactcaacgtcacgctggtggaggcgggcgaacgtattctgcctgcgctaccaccacgtatctcctctgcggcccatcaggagctcagcaagcttggcgtacgcgttctgacacaaacgatggtgaccagcgcagacaagctgggcctgcataccaaaagtggcgagtttattgaagccgacttaatggtctgggcggcagggattaaagcgcctgactttatgaaagcgatcggcgggctggaaaccaatcgcatcaaccagctggtggtgaaagagacactccagaccacgctggatgacgacatctatgccatcggtgattgcgcgtcctgcgccttacccggcggtggatttgtgcccccgcgcgcgcagtccgcacaccagatggcatcctgtgcgctggataatatcctgttgcaataccagggcaagccgcttaaagcctatgtttataaagaccacggttcactggtttctctgtcacgcttcagcaccgtaggaagcctgatgggcaatctgatgcgcggatcgatgatgatagaagggcgcattgcccgatttgtctatatatcactgtatcgtatgcatcaggtcgcgttgcacggttatattaagaccgggctaatgatgatcgtgggcagtctcaaccgggtcatccgcccccgtctgaagcttcactaa

SEQ ID NO: 32 - protein, 415 aa, Pantoea ananatis
MATQLGHKLGRKKKAEIILVDRNHSHLWKPLLHEVATGSMDEGIDALSYLAHARNHGFQFQLGSLTNINREKKVIQLAEVVNSQGEVLVPERELAYDTLVMALGSTSNDFGTPGVKDHCIFLDNPQQARRFHNEMLNLFLKFSASEGAVEKVNIAIVGGGATGVELSAELHNAVKQLHSYGYKALGSEALNVTLVEAGERILPALPPRISSAAHQELSKLGVRVLTQTMVTSADKLGLHTKSGEFIEADLMVWAAGIKAPDFMKAIGGLETNRINQLVVKETLQTTLDDDIYAIGDCASCALPGGGFVPPRAQSAHQMASCALDNILLQYQGKPLKAYVYKDHGSLVSLSRFSTVGSLMGNLMRGSMMIEGRIARFVYISLYRMHQVALHGYIKTGLMMIVGSLNRVIRPRLKLH

SEQ ID NO: 33 - DNA, 1647 bp, Escherichia coli
  CDS (1)..(1647)
atgaaaaaagtgactgccatgctcttctcgatggccgtggggcttaatgccgtttcgatggcggcaaaagcgaaagcgtccgaggagcaggaaactgatgtactgttgattggcggcggcattatgagcgccacgttggggacctatttacgcgagctggagcctgaatggtcgatgaccatggtggagcgcctggagggtgtcgcgcaggagagttcgaacggctggaataacgccggaaccgggcattctgcactgatggaactgaactacaccccgcaaaacgccgatggcagcatcagtattgaaaaagcagtcgccattaacgaagcatttcagatttcccgccagttctgggcgcaccaggttgagcgcggcgtgctgcgtactccgcgttcatttatcaataccgttccgcatatgagctttgtctggggcgaggataacgtcaatttcctgcgcgcccgttacgccgcgttgcaacaaagctcgctgtttcgcggtatgcgttactctgaagatcacgcgcagatcaaagagtgggcaccgttagtgatggaagggcgcgatccgcaacagaaagtggcagccacgcgtacggaaattggtaccgatgtgaactacggcgagatcacccgccagttaattgcttccttgcagaagaaatctaacttctcgctgcaactcagcagcgaagtccgcgccctaaagcgtaatgacgataacacctggaccgttaccgttgccgatctgaaaaatggcactgcacagaacattcgtgccaaatttgtctttatcggcgcgggcggtgcggcgctgaagctgttacaggaatcggggattccggaagcgaaagactacgccggtttcccggtgggcggacagttccttgtttcggaaaacccggacgtggttaatcaccatctggcgaaggtttacggtaaagcatccgttggcgcaccaccgatgtcggttccgcatatcgatacccgcgttctggacggtaaacgcgtagtgctgtttgggccatttgccaccttctcaaccaaattcctcaaaaacggttcattgtgggatctaatgagttccaccaccacctctaacgtgatgccgatgatgcacgtcgggctggataatttcgatctggtgaaatatctggtgagtcaggtgatgttgagtgaagaggatcgttttgaagcgttgaaagagtactatccgcaggcgaaaaaagaggactggcgtttgtggcaagcggggcagcgcgtgcagattatcaagcgtgatgccgagaaaggtggcgtactgcgtctgggtactgaagtcgtcagtgaccagcaaggaaccattgccgcgctcctgggggcatcgccaggggcgtcaaccgccgcgccgattatgttgaatctgctggaaaaagtatttggcgatcgtgtttccagcccgcaatggcaggctacgttgaaagcgatcgttccgtcttatggacgcaagctgaacggtgatgtagcggcaacagaacgcgagttgcagtacaccagcgaagtgctggggttgaactacgacaagccgcaggcagcagatagtacgccgaaaccgcagttgaaaccgcaacccgttcaaaaagaagtggcggatattgcgttgtaa

SEQ ID NO: 34 - protein, 548 aa, Escherichia coli [sequence omitted]

SEQ ID NO: 35 - DNA, 1650 bp, Pantoea ananatis
  CDS (1)..(1650)
atgattaaatcaactaaatttgtacctgcactgtcgcttgcagcgttactcgtttcttcagtgacccacgctgaaaattcaccagaaaaaacagatgttctgctgattggcggcggtatcatgagcgcctctctgggcaccctgctggaagagctgcaaccgggctggaaacagatcatggttgagaaacttgatggcgtagcgctggaatcctctaacggctggaacaacgccggtaccggccactcagccaacatggaactgaactacacgccagagcgtgcagacggttctattgacgtgaccaaagcgctggaaatcaacgaagccttcatgatttctcgtcagttctggagctctcaggttaaagacggcgtgttaaataatccgcgttcgttcattaactcaacgccgcacatgagctttgtctggggcgataacgttgattatctgacgaaacgctatgccgcactgcagaaaactgtgctgttccagggcatgaagttctcaaccgatcacaagcagatcgcgcagtgggcgccgctggttatggaaggtcgcgatccacaacaaaaagtggctgctacctggacgccagtaggaaccgacgttaactatggtgaaatcacccgtcagttaattggcagcctgaagaagaacgataatttccgcctggaaacctcttcggaagtgaccgattttaaacgtaacagtgataattcctggcacgttaccattaaagacgccaaaaatggcggcgaacgtaccgtagacgcgaaatacgtctttatcggtgcaggtggcggtgcgcttaaactgctgcaaaaaaccggtattccggaagccgacaattacgcaggtttcccggtagggggatccttcctggtgacagagaatagcgcgattgccgatcgccatctggcaaaagtgtatggtcaggcttccgtgggtgcgccaccgatgtcggttccgcatctggatacccgttaccttgatggtaagcgtgtcgtgctgtttggacctttcgcaacgttctcaaccaagttcctgaaaaatggttcgttgtttgatttactgagcacaacgaccacccacaactttatgccgatgacccacgtaggcatggataactttgacctggtcaaatacctgatcggtcaggttatgttgagcgatgatgaccgttttgccgcgctgaaagagtactatcctgaagcgaagaaagaagactggaaactgattcaggccggtcagcgcgtgcagatcatcaaaaaggatgcggataaaggcggcgtgctgaaactgggtacggaaattgtgaccgatcagcagaaaaccgttgccgcattgctgggtgcatcgcctggcgcatccacggctgcacctatcgcaatcaatgtgatgcagaaactgttccctgaacaattcaagtcagcagaatggcaggaaaaaatccgtaaaatcgttcctgcttacggccaaaaactgaacgacaaccctgcgctcacacagcaggtctgggatgaaacggcagcaacgctgcagctgaccaagccgccggttattcagatgggcaatcagccaactgaagcgcccgctgctaacagcgaaaaagccccagcctcggcgaagcacgatatggcgctgtaa

SEQ ID NO: 36 - protein, 549 aa, Pantoea ananatis
MIKSTKFVPALSLAALLVSSVTHAENSPEKTDVLLIGGGIMSASLGTLLEELQPGWKQIMVEKLDGVALESSNGWNNAGTGHSANMELNYTPERADGSIDVTKALEINEAFMISRQFWSSQVKDGVLNNPRSFINSTPHMSFVWGDNVDYLTKRYAALQKTVLFQGMKFSTDHKQIAQWAPLVMEGRDPQQKVAATWTPVGTDVNYGEITRQLIGSLKKNDNFRLETSSEVTDFKRNSDNSWHVTIKDAKNGGERTVDAKYVFIGAGGGALKLLQKTGIPEADNYAGFPVGGSFLVTENSAIADRHLAKVYGQASVGAPPMSVPHLDTRYLDGKRVVLFGPFATFSTKFLKNGSLFDLLSTTTTHNFMPMTHVGMDNFDLVKYLIGQVMLSDDDRFAALKEYYPEAKKEDWKLIQAGQRVQIIKKDADKGGVLKLGTEIVTDQQKTVAALLGASPGASTAAPIAINVMQKLFPEQFKSAEWQEKIRKIVPAYGQKLNDNPALTQQVWDETAATLQLTKPPVIQMGNQPTEAPAANSEKAPASAKHDMAL

SEQ ID NO: 37 - DNA, 990 bp, Escherichia coli
  CDS (1)..(990)
atgaaactcgccgtttatagcacaaaacagtacgacaagaagtacctgcaacaggtgaacgagtcctttggctttgagctggaattttttgactttctgctgacggaaaaaaccgctaaaactgccaatggctgcgaagcggtatgtattttcgtaaacgatgacggcagccgcccggtgctggaagagctgaaaaagcacggcgttaaatatatcgccctgcgctgtgccggtttcaataacgtcgaccttgacgcggcaaaagaactggggctgaaagtagtccgtgttccagcctatgatccagaggccgttgctgaacacgccatcggtatgatgatgacgctgaaccgccgtattcaccgcgcgtatcagcgtacccgtgatgctaacttctctctggaaggtctgaccggctttactatgtatggcaaaacggcaggcgttatcggtaccggtaaaatcggtgtggcgatgctgcgcattctgaaaggttttggtatgcgtctgctggcgttcgatccgtatccaagtgcagcggcgctggaactcggtgtggagtatgtcgatctgccaaccctgttctctgaatcagacgttatctctctgcactgcccgctgacaccggaaaactatcatctgttgaacgaagccgccttcgaacagatgaaaaatggcgtgatgatcgtcaataccagtcgcggtgcattgattgattctcaggcagcaattgaagcgctgaaaaatcagaaaattggttcgttgggtatggacgtgtatgagaacgaacgcgatctattctttgaagataaatccaacgacgtgatccaggatgacgtattccgtcgcctgtctgcctgccacaacgtgctgtttaccgggcaccaggcattcctgacagcagaagctctgaccagtatttctcagactacgctgcaaaacttaagcaatctggaaaaaggcgaaacctgcccgaacgaactggtttaa

SEQ ID NO: 38 - protein, 329 aa, Escherichia coli
MKLAVYSTKQYDKKYLQQVNESFGFELEFFDFLLTEKTAKTANGCEAVCIFVNDDGSRPVLEELKKHGVKYIALRCAGFNNVDLDAAKELGLKVVRVPAYDPEAVAEHAIGMMMTLNRRIHRAYQRTRDANFSLEGLTGFTMYGKTAGVIGTGKIGVAMLRILKGFGMRLLAFDPYPSAAALELGVEYVDLPTLFSESDVISLHCPLTPENYHLLNEAAFEQMKNGVMIVNTSRGALIDSQAAIEALKNQKIGSLGMDVYENERDLFFEDKSNDVIQDDVFRRLSACHNVLFTGHQAFLTAEALTSISQTTLQNLSNLEKGETCPNELV

SEQ ID NO: 39 - DNA, 993 bp, Pantoea ananatis
  CDS (1)..(993)
atgaaaatcgccgtatacagtactaaacactatgaccagaagtaccttgaacaggtcaaccaacagtatggtttcgaactggtcttttttgattttttactcagcgaaagcacggcgaagacagcagtagactgcgatgcggtatgtatctttgtgaatgatgacggcagccgcccggtgctcgaagagctggcggggctgggcgtccgctacattgccctgcgctgtgcgggatttaacaatgtcgatctcgacgcggcagccgaactggggcttcaggtcgtccgcgtgcctgcctactccccggaggccgttgccgagcatgcggtggggctgatgatgacgctgaaccgccggattcatcgcgcttaccagcgcacccgcgacgccaatttttcgctggacggcctgaccggttttaacatgcataacaaaacggccggtatcattggcaccggcaaaatcggcatcgccacgctgcgcatattaaaagggttcggaatgcgtttactggcgtttgatccttatcccagcgagcaggctttagcgctcggcgcggaatatgtcgatctgaaaaccctgtttgccgagtcgcacgtcatcagtctgcactgtccactgacggcggagaaccatcatttactcaacgcacaggctttttcgcagatgcgtgacggcgtcatgatcattaacaccagtcggggcggattaattgattctcaggctgcgattgatgcgttgaagcagcaaaaaataggtgcgctgggcatggacgtttatgaaaacgagcgagatctgttctttgaagacaaatctaatgatgtgattcaggatgatgtattccgccgcctgtcagcctgtcataacgtgctgtttaccggtcatcaggcgtttctcaccgccgaagccctgacggcaatttcagacaccacgctggaaaacctcagccagctaaaccgcggcgaaacctgtcagaatcggattaccgcctga

SEQ ID NO: 40 - protein, 330 aa, Pantoea ananatis
MKIAVYSTKHYDQKYLEQVNQQYGFELVFFDFLLSESTAKTAVDCDAVCIFVNDDGSRPVLEELAGLGVRYIALRCAGFNNVDLDAAAELGLQVVRVPAYSPEAVAEHAVGLMMTLNRRIHRAYQRTRDANFSLDGLTGFNMHNKTAGIIGTGKIGIATLRILKGFGMRLLAFDPYPSEQALALGAEYVDLKTLFAESHVISLHCPLTAENHHLLNAQAFSQMRDGVMIINTSRGGLIDSQAAIDALKQQKIGALGMDVYENERDLFFEDKSNDVIQDDVFRRLSACHNVLFTGHQAFLTAEALTAISDTTLENLSQLNRGETCQNRITA

SEQ ID NO: 41 - DNA, 2676 bp, Escherichia coli
  CDS (1)..(2676)
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 42 - protein, 891 aa, Escherichia coli
MAVTNVAELNALVERVKKAQREYASFTQEQVDKIFRAAALAAADARIPLAKMAVAESGMGIVEDKVIKNHFASEYIYNAYKDEKTCGVLSEDDTFGTITIAEPIGIICGIVPTTNPTSTAIFKSLISLKTRNAIIFSPHPRAKDATNKAADIVLQAAIAAGAPKDLIGWIDQPSVELSNALMHHPDINLILATGGPGMVKAAYSSGKPAIGVGAGNTPVVIDETADIKRAVASVLMSKTFDNGVICASEQSVVVVDSVYDAVRERFATHGGYLLQGKELKAVQDVILKNGALNAAIVGQPAYKIAELAGFSVPENTKILIGEVTVVDESEPFAHEKLSPTLAMYRAKDFEDAVEKAEKLVAMGGIGHTSCLYTDQDNQPARVSYFGQKMKTARILINTPASQGGIGDLYNFKLAPSLTLGCGSWGGNSISENVGPKHLINKKTVAKRAENMLWHKLPKSIYFRRGSLPIALDEVITDGHKRALIVTDRFLFNNGYADQITSVLKAAGVETEVFFEVEADPTLSIVRKGAELANSFKPDVIIALGGGSPMDAAKIMWVMYEHPETHFEELALRFMDIRKRIYKFPKMGVKAKMIAVTTTSGTGSEVTPFAVVTDDATGQKYPLADYALTPDMAIVDANLVMDMPKSLCAFGGLDAVTHAMEAYVSVLASEFSDGQALQALKLLKEYLPASYHEGSKNPVARERVHSAATIAGIAFANAFLGVCHSMAHKLGSQFHIPHGLANALLICNVIRYNANDNPTKQTAFSQYDRPQARRRYAEIADHLGLSAPGDRTAAKIEKLLAWLETLKAELGIPKSIREAGVQEADFLANVDKLSEDAFDDQCTGANPRYPLISELKQILLDTYYGRDYVEGETAAKKEAAPAKAEKKAKKSA

SEQ ID NO: 43 - DNA, 2688 bp, Pantoea ananatis
  CDS (1)..(2688)
atggccgttactaatgtcgctgaactcaatgcactggttgaacgtgtaaaaaaagcccagcaagaattcgccaatttttctcaacaacaggtcgatgccatcttccgcgcagccgcactggccgccgcggatgcccgaattccactcgctaaaatggcggtggcggaatcgggcatgggcattgttgaagacaaagtcattaaaaatcacttcgcttctgaatacatctacaacgcctataaggatgagaaaacctgcggcgtactggacaccgatgatacgtttggcaccatcaccatcgctgaacccatcggcctgatttgcggtattgtccccaccactaaccctacctcgaccgcaatttttaaggcacttatcagccttaaaacccgcaacgggattatcttctccccccatcctcgagccaaagatgcgacgaacaaagcggcggatattgtcctgcaggcagcgattgccgctggcgcgcccaaagacattataggctggattgatgcaccttctgtggaactgtccaatcagttgatgcaccatcctgatattaacctgattctggcgacgggtggccccggcatggtcaaagccgcctacagctcaggtaagccggcgattggcgtgggggccggtaacacgcccgttgtcatcgatgaaacagctgatgttaaacgcgccgttgcctccatcctgatgtcaaaaacgtttgataacggtgtgatctgtgcctctgaacagtcggttatcgtggtggatgccgtctacgacgccgtgcgcgagcgcttcgccagccatggtggctatttgcttcagggacaggagctgagtgcggtacaaaatatcattctaaaaaacggtgggcttaacgccgccattgtgggccagcctgcggtgaagattgcggagatggccggcatcagcgtacctggtgaaaccaaaatcctgattggcgaagttgaacgggtcgatgaatcagaacctttcgctcatgaaaaactgtcgccgacactggcgatgtaccgtgctaaagattatcaggatgccgtcagcaaagcggagaaactggtggcgatgggcggtattggtcatacgtcatgcctgtataccgaccaggacaatcagacagcgcgcgtgcactattttggcgacaagatgaaaacagcccgcattctgatcaacacgccagcttctcagggcggtattggtgatttatataacttcaaactcgccccttctctgacactgggttgtggttcctggggcggtaactccatttctgaaaacgtggggcccaaacatctcatcaacaagaaaaccgtcgctaagcgagctgaaaatatgttgtggcataaacttccgaagtccatttactttcgtcgcggctctttacccattgcgcttgaagagatcgccactgacggtgccaaacgcgcgtttgtggtgactgaccgcttcctgtttaacaacggttatgccgatcaggtcacccgcgttttaaaatctcacggcatcgaaaccgaagttttctttgaggttgaagcggatcccaccttaagcatcgtgcgtaaaggtgcagaacagatgaacagctttaagccagacgtgatcatcgccctgggcggcggttcgccgatggatgcagccaaaatcatgtgggtcatgtatgagcatccagaaacccattttgaagagctggcactgcggtttatggatattcgcaaacgtatctataagttccctaaaatgggcgtgaaagcgcgcatggtggccattacgacaacctcaggcacaggttcagaagtgacgccttttgccgtggtaacggatgacgcgaccggacagaaatacccgctggccgattatgcgctgacgccggatatggctatcgttgatgccaacctggtcatggatatgccacgttcactttgtgccttcggcggtctggatgcggtgacgcacgcgctggaagcctatgtgtccgttctggccaatgaatactccgatggtcaggccctgcaggcgcttaagctgcttaaagagaacttaccggcgagttatgcagaaggtgcaaaaaatccggttgcccgtgaacgtgtacataatgccgccaccatcgccggtatcgcctttgctaacgccttcctcggggtttgtcactcaatggcgcataagcttggctctgagttccatattcctcatggactggctaactcgctgctgatttccaacgttattcgctataacgccaatgacaaccctactaagcaaaccgcattcagccagtacgatcgtccccaggcgcgtcgtcgttatgctgaaattgcggatcatcttggtctcaccgcgacgggcgaccgcactgcccagaaaattgagaagctgctggtatggctggatgagatcaaaacggaactgggtattccggcatcgattcgtgaagccggtgtgcaggaggcagacttcctggcgaaagtcgataaactggcggatgatgcctttgatgaccagtgtactggcgcgaatccacgttatccgctgattgccgaactcaaacagctgatgctggacagctactacggacgcaaatttgtcgagccgttcgccagtgccgccgaggctgcccaggctcagcctgtcagtgacagcaaagcggcgaagaaagctaaaaaagcctaa

SEQ ID NO: 44 - protein, 895 aa, Pantoea ananatis
MAVTNVAELNALVERVKKAQQEFANFSQQQVDAIFRAAALAAADARIPLAKMAVAESGMGIVEDKVIKNHFASEYIYNAYKDEKTCGVLDTDDTFGTITIAEPIGLICGIVPTTNPTSTAIFKALISLKTRNGIIFSPHPRAKDATNKAADIVLQAAIAAGAPKDIIGWIDAPSVELSNQLMHHPDINLILATGGPGMVKAAYSSGKPAIGVGAGNTPVVIDETADVKRAVASILMSKTFDNGVICASEQSVIVVDAVYDAVRERFASHGGYLLQGQELSAVQNIILKNGGLNAAIVGQPAVKIAEMAGISVPGETKILIGEVERVDESEPFAHEKLSPTLAMYRAKDYQDAVSKAEKLVAMGGIGHTSCLYTDQDNQTARVHYFGDKMKTARILINTPASQGGIGDLYNFKLAPSLTLGCGSWGGNSISENVGPKHLINKKTVAKRAENMLWHKLPKSIYFRRGSLPIALEEIATDGAKRAFVVTDRFLFNNGYADQVTRVLKSHGIETEVFFEVEADPTLSIVRKGAEQMNSFKPDVIIALGGGSPMDAAKIMWVMYEHPETHFEELALRFMDIRKRIYKFPKMGVKARMVAITTTSGTGSEVTPFAVVTDDATGQKYPLADYALTPDMAIVDANLVMDMPRSLCAFGGLDAVTHALEAYVSVLANEYSDGQALQALKLLKENLPASYAEGAKNPVARERVHNAATIAGIAFANAFLGVCHSMAHKLGSEFHIPHGLANSLLISNVIRYNANDNPTKQTAFSQYDRPQARRRYAEIADHLGLTATGDRTAQKIEKLLVWLDEIKTELGIPASIREAGVQEADFLAKVDKLADDAFDDQCTGANPRYPLIAELKQLMLDSYYGRKFVEPFASAAEAAQAQPVSDSKAAKKAKKA

SEQ ID NO: 45 - DNA, 2145 bp, Escherichia coli
  CDS (1)..(2145)
gtgtcccgtattattatgctgatccctaccggaaccagcgtcggtctgaccagcgtcagccttggcgtgatccgtgcaatggaacgcaaaggcgttcgtctgagcgttttcaaacctatcgctcagccgcgtaccggtggcgatgcgcccgatcagactacgactatcgtgcgtgcgaactcttccaccacgacggccgctgaaccgctgaaaatgagctacgttgaaggtctgctttccagcaatcagaaagatgtgctgatggaagagatcgtcgcaaactaccacgctaacaccaaagacgctgaagtcgttctggttgaaggtctggtcccgacacgtaagcaccagtttgcccagtctctgaactacgaaatcgctaaaacgctgaatgcggaaatcgtcttcgttatgtctcagggcactgacaccccggaacagctgaaagagcgtatcgaactgacccgcaacagcttcggcggtgccaaaaacaccaacatcaccggcgttatcgttaacaaactgaacgcaccggttgatgaacagggtcgtactcgcccggatctgtccgagattttcgacgactcttccaaagctaaagtaaacaatgttgatccggcgaagctgcaagaatccagcccgctgccggttctcggcgctgtgccgtggagctttgacctgatcgcgactcgtgcgatcgatatggctcgccacctgaatgcgaccatcatcaacgaaggcgacatcaatactcgccgcgttaaatccgtcactttctgcgcacgcagcattccgcacatgctggagcacttccgtgccggttctctgctggtgacttccgcagaccgtcctgacgtgctggtggccgcttgcctggcagccatgaacggcgtagaaatcggtgccctgctgctgactggcggttacgaaatggacgcgcgcatttctaaactgtgcgaacgtgctttcgctaccggcctgccggtatttatggtgaacaccaacacctggcagacctctctgagcctgcagagcttcaacctggaagttccggttgacgatcacgaacgtatcgagaaagttcaggaatacgttgctaactacatcaacgctgactggatcgaatctctgactgccacttctgagcgcagccgtcgtctgtctccgcctgcgttccgttatcagctgactgaacttgcgcgcaaagcgggcaaacgtatcgtactgccggaaggtgacgaaccgcgtaccgttaaagcagccgctatctgtgctgaacgtggtatcgcaacttgcgtactgctgggtaatccggcagagatcaaccgtgttgcagcgtctcagggtgtagaactgggtgcagggattgaaatcgttgatccagaagtggttcgcgaaagctatgttggtcgtctggtcgaactgcgtaagaacaaaggcatgaccgaaaccgttgcccgcgaacagctggaagacaacgtggtgctcggtacgctgatgctggaacaggatgaagttgatggtctggtttccggtgctgttcacactaccgcaaacaccatccgtccgccgctgcagctgatcaaaactgcaccgggcagctccctggtatcttccgtgttcttcatgctgctgccggaacaggtttacgtttacggtgactgtgcgatcaacccggatccgaccgctgaacagctggcagaaatcgcgattcagtccgctgattccgctgcggccttcggtatcgaaccgcgcgttgctatgctctcctactccaccggtacttctggtgcaggtagcgacgtagaaaaagttcgcgaagcaactcgtctggcgcaggaaaaacgtcctgacctgatgatcgacggtccgctgcagtacgacgctgcggtaatggctgacgttgcgaaatccaaagcgccgaactctccggttgcaggtcgcgctaccgtgttcatcttcccggatctgaacaccggtaacaccacctacaaagcggtacagcgttctgccgacctgatctccatcgggccgatgctgcagggtatgcgcaagccggttaacgacctgtcccgtggcgcactggttgacgatatcgtctacaccatcgcgctgactgcgattcagtctgcacagcagcagtaa

SEQ ID NO: 46 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIESLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 47 - DNA, 2145 bp, Pantoea ananatis
  CDS (1)..(2145)
gtgtcacgtacaattatgctcattccgaccggcaccagcgtcggtctgaccagcgttagccttggcgttattcgcgccatggaacgtaaaggcgttcgactgagcgttttcaaacccattgcacaaccgcgtgcgggcggcaatgcacctgaccagaccaccagcattgtgcgcaagagttcaggcatcccggccgcagagccgctgccgatgtcccgtgtggaatcgctgctgggctctaatcagcaagacgtgctgatggaagaaattattgcccgctaccacgccaatgcgcaggatgctgaagtggttctggttgaaggcctggtgcctacgcgtaagcaccagtttgccagcgcgctgaactatgaaatcgccaaaacgttaaacgctgaaatcgtcttcgtgaccgcgctgggtaacgattctcccgcacagctcaaagagcgtattgaactgacacaaagcagctttggcggttcgaagaataaaagcatcaccggtgtgatcatcaacaagctgaacgcgcccgttgatgagcagggccgtacgcgccctgacctgtctgaaattttcgatgactcatcgaaggccagcatcgcgaatatcaatcctgaccagctgtttgccaacagtcccttgcccattttgggttgtgtgccgtggagcttcgacctgattgcaacccgcgccattgatatgtgccgccacctgaacgcccgaattattaacgaaggtgaaattcagacccgtcgtgtcaaatcagtgaccttctgcgcacgcagcatcccgcacatgcttgagcatttccgcccgggctcgctgctggtcacctcggctgaccgccctgacgtgctggttgccgcctgtctggccgcgatgaacggtattgagatcggtgccattcttttaaccggtaactatgaaattgacgagcgcatcgccaaactgtgcgatcgcgccttccagactggcctgccggtcttcatggtcaaaaccaatacctggcagacctcgctcagcctgcaaagctttaacctcgaagtaccggttgatgacacgcagcgcattgaaaaagtccaggaatacgtcgcaagttacattaacgcggactggatcgagtcgctgaccgccacgtctgaacgcagtcgccgcctgtcgccgccagctttccgctatcagttaaccgaactggctcgcaaggctggcaagcgcattgttctgccggaaggggatgaaccccgtaccgttaaagccgcagcaatctgtgccgaccgcggcattgcgacctgtgtcctgctgggcaatccggatgaaatccagcgcgttgcggcagcccagggcgttgagctgggtaaaggcattgagatagtcgatcctgaagtggtgcgtcagaactatgttccgcgtctggtcgagctgcgcaaaagcaaaggcatgaccgaggtggttgcgcaggaacagctggaagataacgtggtgctgggcaccatgatgctggaaagcggggaagttgacgggttggtctcgggcgcggtacataccacggccaacaccattcgtccgccgttacagctgatcaaaaccgcgcccaacagctcactggtgtcatccgtgttctttatgctgctgccagagcaggtgctggtctacggcgactgcgcgatcaaccccgatccaacggctgaacagctggcagaaattgccattcagtctgccgattcagcgaaagccttcggcatcgatccacgcgtcgccatgatttcctactcaaccggtaattcaggtgccggtagcgacgtggagaaagtgcgtgaagccacgcgccttgcgcaggaaaaacgcccggatctggtgattgatgggccgttgcagtacgacgcggcgattatggaagacgtggcaaaatccaaggcgcccaactcgcaggttgccggacgcgcaacggtctttattttcccggatctcaacaccggtaacaccacctacaaagcggtgcagcgttccgctgacctgatttcaatcgggccaatgctgcagggcatgcgtaagccggtcaacgacctgtcacgcggcgcactggtagacgatatcgtctacaccatcgccctgacggcgattcagtcgcagcaggctgaaggttaa

SEQ ID NO: 48 - protein, 714 aa, Pantoea ananatis
MSRTIMLIPTGTSVGLTSVSLGVIRAMERKGVRLSVFKPIAQPRAGGNAPDQTTSIVRKSSGIPAAEPLPMSRVESLLGSNQQDVLMEEIIARYHANAQDAEVVLVEGLVPTRKHQFASALNYEIAKTLNAEIVFVTALGNDSPAQLKERIELTQSSFGGSKNKSITGVIINKLNAPVDEQGRTRPDLSEIFDDSSKASIANINPDQLFANSPLPILGCVPWSFDLIATRAIDMCRHLNARIINEGEIQTRRVKSVTFCARSIPHMLEHFRPGSLLVTSADRPDVLVAACLAAMNGIEIGAILLTGNYEIDERIAKLCDRAFQTGLPVFMVKTNTWQTSLSLQSFNLEVPVDDTQRIEKVQEYVASYINADWIESLTATSERSRRLSPPAFRYQLTELARKAGKRIVLPEGDEPRTVKAAAICADRGIATCVLLGNPDEIQRVAAAQGVELGKGIEIVDPEVVRQNYVPRLVELRKSKGMTEVVAQEQLEDNVVLGTMMLESGEVDGLVSGAVHTTANTIRPPLQLIKTAPNSSLVSSVFFMLLPEQVLVYGDCAINPDPTAEQLAEIAIQSADSAKAFGIDPRVAMISYSTGNSGAGSDVEKVREATRLAQEKRPDLVIDGPLQYDAAIMEDVAKSKAPNSQVAGRATVFIFPDLNTGNTTYKAVQRSADLISIGPMLQGMRKPVNDLSRGALVDDIVYTIALTAIQSQQAEG

SEQ ID NO: 49 - DNA, 1884 bp, Chlorobium tepidum
  CDS (1)..(1884)
atgagtgacaccgtaatcttaaacaacaatgacatggtaatatcaaaaaccaacgtgtcagtgctttttgccggtgactccggtgacggcatgcagcttaccggcacccagttcgccaacacggtggccgtttacggctcggatttgaacacctttccgaactttccttcggaaatcagacctcctgccggtactgtggcaggcgtatcgggctttcagttgcagtttggcacaaccggcgtctatactccgggcgcgaagttcgatgtcatgatcgccatgaacgctgccgcgctgaaggcaaacctgaagaacctgcaccatggtggcatcatcattgctgataccgacgggttcgacgcaaagaacctgaaccttgctggttacggtgaaaccaacaatccgctcgaagacggcacgctgactgattataccgtattcaaaattccggtaatcagcctcacccgccaggcgcttgccgatacaggcctgagcaccaagatcatcgaccgctgcaaaaacatgttcgtgctcggcgtgctctactggctctacagcctgccactcgaaaccacgatcgaggcattgcagtcaaaattcaagaataaacaggacattgccgaggccaacatcaaagccgtcaaggcaggctacaacttcggcgatgaaaccgaaatgttctcacagcatggtcgtttttgtgtccctccggcccagaaaaaaaagggtgtttatcgccgcgtgactggcaacgaagcttcggctatcggtcttgccgctgccgcccaaaaggctggactggaactctttctcggctcctatccgatcaccccggcttccgaaattctccagacccttgccggcttgaaaaagtggggcgtcaaaacgttccaggctgaagacgaaatagccggtatcctgaccagcatcggcgcggcctatggaggtgcgcttgccgccaccaacacctccggccccggtctggcgctcaaaaccgaagggatgggtttggcggttatcctcgaacttccgctggtgatcatcaatgtgatgcgcggcggcccgtccaccggtctgccgaccaagccggagcagtccgatctgctcatggctatgtacggacgtcacggcgaagcgccgatgccggtcatcgcggccatgtcgccggttgactgcttctacgccgcctacgaagccgcgaagatcgccgtcgagtacatgactcctgtcctttgcctcaccgacggctacctcgcactcagctctgagccgatgctggtgccatcgccggacgagctggcctcgatcactcccatgttctcgccagagcgcaaagccgacgatccgccgtatctgccgtacaagcgcgacgagcgctgcgtcaggccgtggggcatccccggcacacctggtctcgaacaccgcatcggcggtctcgaaaagcagaatgaaaccggccacgtttcgcacgatccggaaaaccatgcactcatgaccagattgcgtgctgaaaaggttgcaaaggtcgccgatattattcctgatctcaccatcgacaacggcccggaaaaaggcgatctgctcgtcctcggctggggttcgacctatggcgccatcaagaaagccgtcgagcaggctcgcgaaggcggacttgacgttgcccacgcgcacctccgctatatcaacccgttcccgaaaaatctcggcgcgatgctcggaaacttcaaaaaagtgctgattcccgaaaacaactgcgggcagctgctcagcctcatcagggacaagttcctcatcgaaccggtcggcttcagcaaggttcagggcctgccgttcaacgagatggaaatcgaagaaaaaatcaccgatatcttaaaggagctctga

SEQ ID NO: 50 - protein, 627 aa, Chlorobium tepidum
MSDTVILNNNDMVISKTNVSVLFAGDSGDGMQLTGTQFANTVAVYGSDLNTFPNFPSEIRPPAGTVAGVSGFQLQFGTTGVYTPGAKFDVMIAMNAAALKANLKNLHHGGIIIADTDGFDAKNLNLAGYGETNNPLEDGTLTDYTVFKIPVISLTRQALADTGLSTKIIDRCKNMFVLGVLYWLYSLPLETTIEALQSKFKNKQDIAEANIKAVKAGYNFGDETEMFSQHGRFCVPPAQKKKGVYRRVTGNEASAIGLAAAAQKAGLELFLGSYPITPASEILQTLAGLKKWGVKTFQAEDEIAGILTSIGAAYGGALAATNTSGPGLALKTEGMGLAVILELPLVIINVMRGGPSTGLPTKPEQSDLLMAMYGRHGEAPMPVIAAMSPVDCFYAAYEAAKIAVEYMTPVLCLTDGYLALSSEPMLVPSPDELASITPMFSPERKADDPPYLPYKRDERCVRPWGIPGTPGLEHRIGGLEKQNETGHVSHDPENHALMTRLRAEKVAKVADIIPDLTIDNGPEKGDLLVLGWGSTYGAIKKAVEQAREGGLDVAHAHLRYINPFPKNLGAMLGNFKKVLIPENNCGQLLSLIRDKFLIEPVGFSKVQGLPFNEMEIEEKITDILKEL

SEQ ID NO: 51 - DNA, 1029 bp, Chlorobium tepidum
  CDS (1)..(1029)
atgaccgatacacatacctgccttaccgccaaggatttcacgtcgaaccaggaaccgaaatggtgccccggctgtggtgacttcatggttctccagcaactcaagaacgcgatggctgaactgtgcctgaaaaccgaagaggttgtcgtggtatcgggcattggctgctcgtcaaggctgccatactatatcaacacctacggcgtgcacggcatccacgggcgcgccatggcgatggcttccggtctgaaggttgcccgccctgacctcagcgtctgggtcggcaccggcgatggcgacgccctctccatcggcggcaaccattacatccacacggtcagacggaacctcgacatcaacgtcgtgctgttcaacaacgagatttacggcctgaccaagggacagtactcgccgacctcgaaagtgggtttgagaaccgtcacctctccgaccggcgtggtggattatccgatcaacaccatcgccctcacccttggcgcaggaggcaccttcgtggcccgcgtcatggatcgcgacggcaagctgatgaaggagattttcaagcgcgcccacaaccacaaaggcacctcgatcgtcgagatttaccagaactgcccgattttcaacgacggcgcgtttagagccttcagcgacaaggagcggaaggacgacacgacgctttacctcgaacagggccagccgctggtgttcggtgcgaacggctcgaagggcatctacctcgacggtttcaaaccaacggtgattgacctcgaaaaatcgggcgtttcaaaagatgacctctggattcacgacgaaaacgacctcatcaaggcaaacatcctgtcgcgcttcttcgacgatccgaacagcaccgaggagttcctcccgaggccgttcggtatcttctatgtggaggatcgcttcacctacgaacaggctctgagcgcccagatcgacaaggcgcaggaaaaaggcgaaggcaccctcgaagaactgcttgctggcaacagcacctggacgatcaactga

SEQ ID NO: 52 - protein, 342 aa, Chlorobium tepidum
MTDTHTCLTAKDFTSNQEPKWCPGCGDFMVLQQLKNAMAELCLKTEEVVVVSGIGCSSRLPYYINTYGVHGIHGRAMAMASGLKVARPDLSVWVGTGDGDALSIGGNHYIHTVRRNLDINVVLFNNEIYGLTKGQYSPTSKVGLRTVTSPTGVVDYPINTIALTLGAGGTFVARVMDRDGKLMKEIFKRAHNHKGTSIVEIYQNCPIFNDGAFRAFSDKERKDDTTLYLEQGQPLVFGANGSKGIYLDGFKPTVIDLEKSGVSKDDLWIHDENDLIKANILSRFFDDPNSTEEFLPRPFGIFYVEDRFTYEQALSAQIDKAQEKGEGTLEELLAGNSTWTIN

SEQ ID NO: 53 - DNA, 1866 bp, Blastopirellula marina
  CDS (1)..(1866)
atgtccaccgaatttgaaagcgaaactgatcactccaaagcagttttgaagattgaagaagcgactgtccgcttttgcggcgattctggcgacggaatgcaactcgccggaacccagttgaccaacacttcggcgctcgccggcaacgacgtcgccacctttcccgactttcccgccgagattcgcgctccgcgcggtacgctcgccggcgtctccggctttcaggtccatttctcgtcgaccgacatttacacgccgggtgaaacggtcgacgcgctgatcgcgatgaacccggccgctttgaaaacgaacatcgccgacctcaagtcaggcggcgtgctgatcgccaactcggacgcgtttgataaaaaatcgctcgaacaagctgggtacgacgacaatccgctcgatgacgagacgctcgattcgtatcaactgtttcaggttccgatgaccgacatgacgcgccgcgccgtcgacgggcttgatctgagtcaaaaagaagcggaccgctgccgcaactttttcgccatgggactggcgttttggctctatggacgatcgctggaaccgacgcggcgatttatcgatttgaagttcaaaaagctgccggccatcgccgaagcgaaccgtcgcgccctcgccgccggtcgcaattatggcgaaacgaccgatgctttcgtcagctcgttttcggtcgataaagcaaaactgtctcccggcacgtatcgcaatatgaccggcaaccaggcgctggcttggggtttgatgacggcggccaagttgagcggaaaagagttgtttctcggttcttatccgatcacgccggccagtgatattttgcatgaactgagccgctacaaaaacttcggcgtgcggacgtttcaggccgaagacgaaatcgcggcgatctgctcggcgatcggcgccgcttattcaggacacatggcgctgaccacgtcgagcggaccagggatcgcgctcaaaggagaagcgatgggcctggcggtcatgctggaattgccgctgttggtcgtgaacgtgcagcgcggcggaccaagcaccggacttcctaccaaaacggagcaagcggacctgttacaggtgatgtttggccgcaacggcgaatgcccgctgccggtgatatcggctcgcagtccggccgattgttttgaagttgcgattgaagcatggcgcgtcgccgcgcggtttatgacgccggtcatgatcctcagcgacggctatttggcgaatgggtccgaaccgtggcgcatcgtcaactatcaagatctcaagccgattccgatcacccatcccgaagcgccgaccaacggcaaaccgtttttggcgtacgaacgtgacgagctgctcgctcggccttgggcgatccccggcacgcctgggttgatgcatcgcgtcggcggtttagaaaaagcggatgggaccggcaacgtcagctacgatccaatcaaccatcagcacatgaccgacacccgggcgcaaaaagtggccaatgtcgcccaagtgatcggcgatcaagaggtgatgggggatccggccggcgacttgttggtgcttagctggggcggaccctacggatcgtgtcgcacggcggtaacgcgactccaagccgaagggcacaaggtcagccatgcgcatctccggtggctcaatccgttcccggccaatttgggcgagatcctgcgtagctttaagaaggtgctcattcccgagctgaacatgggacaactgtcgatgttgattcgcaaccaatttttgatcgacaccatcggcctgaacaaagtgcaaggcaaaccgtttcaggtcgccgagatcatcgacaaagcggaatcgctgttgccgtaa

SEQ ID NO: 54 - protein, 621 aa, Blastopirellula marina
MSTEFESETDHSKAVLKIEEATVRFCGDSGDGMQLAGTQLTNTSALAGNDVATFPDFPAEIRAPRGTLAGVSGFQVHFSSTDIYTPGETVDALIAMNPAALKTNIADLKSGGVLIANSDAFDKKSLEQAGYDDNPLDDETLDSYQLFQVPMTDMTRRAVDGLDLSQKEADRCRNFFAMGLAFWLYGRSLEPTRRFIDLKFKKLPAIAEANRRALAAGRNYGETTDAFVSSFSVDKAKLSPGTYRNMTGNQALAWGLMTAAKLSGKELFLGSYPITPASDILHELSRYKNFGVRTFQAEDEIAAICSAIGAAYSGHMALTTSSGPGIALKGEAMGLAVMLELPLLVVNVQRGGPSTGLPTKTEQADLLQVMFGRNGECPLPVISARSPADCFEVAIEAWRVAARFMTPVMILSDGYLANGSEPWRIVNYQDLKPIPITHPEAPTNGKPFLAYERDELLARPWAIPGTPGLMHRVGGLEKADGTGNVSYDPINHQHMTDTRAQKVANVAQVIGDQEVMGDPAGDLLVLSWGGPYGSCRTAVTRLQAEGHKVSHAHLRWLNPFPANLGEILRSFKKVLIPELNMGQLSMLIRNQFLIDTIGLNKVQGKPFQVAEIIDKAESLLP

SEQ ID NO: 55 - DNA, 1020 bp, Blastopirellula marina
  CDS (1)..(1020)
atggctcccgtcgaactacccgtgctcaagcctggcgatttcggcagcgatcaggatgttcgctggtgccccggttgcggcgactattcgattcttgcgcagatgaaaaaagtgatggccgccctggcgtggccgcgtgagaaaacggtcttcgtctctgggatcggctgcagcagtcgctttccgtactacatgaacacgtacggcatgcacagcattcatggacgcgctcccgctttcgccaccggcatcaagagttgccgtcctgatctgcacgtctttgtcatcaccggcgacggtgatgcgctcagcatcggcggcaatcattttatgcatgtcgttcgccgtaacgtaaacttgaacattattttgttcaataatcgaatatacgggctcaccaaagggcaatattcgccgacttcggaattgggcaagatcaccaaaagtacgccgatgggggcgatcgataatccgatgaatcccctgtcgctggcgatcggctgcgaagcgacctttgtcgcgcggtcgatcgacgtgcatatcaaacacctggcggatacgctgaagcgagccgccgaacacccaggagtctcgtttgtcgaggtttatcaaaactgcaatgtgttcaacgacggcgcctacaagtatgcgaccgacaaatcggtgaagtcggacaatatcatcgaaatcgagcatggcaagccgctgatttttggtaagaatagagacaaggggattcgcttaaacggcatgcagccagaagtggtcgaactgggtaaaggcattaccgaagacgacctgctgtttcatgacgaactagccccagagccgacgctcgcctacttgctaagtcggatgcgatatcctgaatttcccgagccgatcggcgtgttgcgttgcgtcgatgctcctcggtatgacgaacttttaaacgaacaggtcgctcaagcgcgagccgaaaagggagaaggagacttggataagctctttcgctctggcgatacctggacggtagaatag

SEQ ID NO: 56 - protein, 339 aa, Blastopirellula marina
MAPVELPVLKPGDFGSDQDVRWCPGCGDYSILAQMKKVMAALAWPREKTVFVSGIGCSSRFPYYMNTYGMHSIHGRAPAFATGIKSCRPDLHVFVITGDGDALSIGGNHFMHVVRRNVNLNIILFNNRIYGLTKGQYSPTSELGKITKSTPMGAIDNPMNPLSLAIGCEATFVARSIDVHIKHLADTLKRAAEHPGVSFVEVYQNCNVFNDGAYKYATDKSVKSDNIIEIEHGKPLIFGKNRDKGIRLNGMQPEVVELGKGITEDDLLFHDELAPEPTLAYLLSRMRYPEFPEPIGVLRCVDAPRYDELLNEQVAQARAEKGEGDLDKLFRSGDTWTVE

SEQ ID NO: 57 - DNA, 747 bp, Escherichia coli
  CDS (1)..(747)
atggctgattgggtaacaggcaaagtcactaaagtgcagaactggaccgacgccctgtttagtctcaccgttcacgcccccgtgcttccgtttaccgccgggcaatttaccaagcttggccttgaaatcgacggcgaacgcgtccagcgcgcctactcctatgtaaactcgcccgataatcccgatctggagttttacctggtcaccgtccccgatggcaaattaagcccacgactggcggcactgaaaccaggcgatgaagtgcaggtggttagcgaagcggcaggattctttgtgctcgatgaagtgccgcactgcgaaacgctatggatgctggcaaccggtacagcgattggcccttatttatcgattctgcaactaggtaaagatttagatcgcttcaaaaatctggtcctggtgcacgccgcacgttatgccgccgacttaagctatttgccactgatgcaggaactggaaaaacgctacgaaggaaaactgcgcattcagacggtggtcagtcgggaaacggcagcggggtcgctcaccggacggataccggcattaattgaaagtggggaactggaaagcacgattggcctgccgatgaataaagaaaccagccatgtgatgctgtgcggcaatccacagatggtgcgcgatacacaacagttgctgaaagagacccggcagatgacgaaacatttacgtcgccgaccgggccatatgacagcggagcattactggtaa

SEQ ID NO: 58 - protein, 248 aa, Escherichia coli
MADWVTGKVTKVQNWTDALFSLTVHAPVLPFTAGQFTKLGLEIDGERVQRAYSYVNSPDNPDLEFYLVTVPDGKLSPRLAALKPGDEVQVVSEAAGFFVLDEVPHCETLWMLATGTAIGPYLSILQLGKDLDRFKNLVLVHAARYAADLSYLPLMQELEKRYEGKLRIQTVVSRETAAGSLTGRIPALIESGELESTIGLPMNKETSHVMLCGNPQMVRDTQQLLKETRQMTKHLRRRPGHMTAEHYW

SEQ ID NO: 59 - DNA, 3558 bp, Chlorobium tepidum
  CDS (1)..(3558)
atgacccggacattcaagacaatggaggggaatgaagctcttgctcatgtcgcctatcgcactaatgaagtcatctcgatatacccgattaccccggcatctccgatgggagagtactccgacgcatgggccgctgtcgatgtaaaaaatatctggggtaccgtgccactcgtcaatgagatgcagagcgaagccggtgccgccgccgccgttcacggcgcgttgcagaccggcgcgctgacgaccaccttcacggcctctcagggtctcttactgatgatcccgaacatgtacaagatcgccggtgaactgaccccctgcgtgattcacgtgtcagcccgttcgctggccgcgcaggcgctctcgatattctgcgaccacggtgacgtgatgtcggtcaggggcaccggcttcgcgctgctcgcttcctgttcggtacaggaggtaatggacatggcgctgatttcgcaggccgcaacgctcgaatcgcgcgtgccattcctgcacttcttcgacggcttccgcacgtcgcacgaaatctcgaaaatcgaggtgctctcggacgaacagattcgctcgatgatcaacgacgagctggtcttcgcacaccgcatgcgccgcatgtcgcctgatgcaccgatcatccgcggtacctcgcagaatccggacgtctatttccaggcacgcgagagcgtcaacaaatattatgaggcctgcccgtcaatcacccagaaggcgatggaccagttcgccaaactgactgggcgcagctataaactttaccagtactacggcgctccggatgccgaccgtatcatcatcatgatggggtcaggtgccgagaccgctctcgaaactgtcgaatacctcaacaaccacggcgaaaaggtcggtctggtcaaggtacgccttttcaggccattcgacgttgcaaccttcatcgcatcgctaccatcgagcgtgaagagtatcgcggtgctcgaccgtgtcaaggaaccaggcagcgctggcgaaccgctctatctcgatgtagtcaacgccgtagccgaatcgtaccaggaaggcaaatgcgcttcgatgccaagcgttttgggtgggcgctatggcctgtcgtcgaaggagttcactccggcgatggtcaaggcgatcttcgacaatatgaacgcggaatctccaaagaatcacttcaccgttggcatcgacgatgacgtaaccaagaagagcctcgcctacgacgagaccttctcgattgagccggactcggtcttccgcgccctcttctacggcctcggttcagacggcacggtcggtgcaaacaagaactcgatcaagatcattggcgaaaacaccgacaactacgcgcagggcttcttcgtctacgactccaagaaagccggttcgatcacgacctcgcacctgcggttcggcccggagcagatccgctcgacctacctcatcaccgaggcgcagttcgtcggctgccaccactgggtctttctcgaaatgatcgacgttgccaagaacctcaagcagggtggtacgctgctcatcaactcggcctatgcgccggatgtggtgtggagcaagctcccgcgtccggtgcagcagcacttgatcgacaagcaggcgaagctctacaccatcgatgcctacaaggtcgcccacgaaagcggcatgggtcagcgcatcaacactatcatgcaggcctgtttcttcgccatttcgggcgtgctgccgcgtgaagaggcaatcgaaaagatcaaggacgcgatccgccacacctacggcaaaaagggcgatgaggtcgttcagcagaacatcaaggcagttgacaacacgcttgccaacctgcatgaagtgaaaatcggcgctgtggcagacagcaccaaggagctgcgctcgcccatcgttggcgacgcgccagagttcgtctgtaacgtgctggcaaagattattgccggcgagggcgactcgattccggtcagcaagctgcctgccgatggaacctatccgctcggcaccacgaagttcgagaaacgcaacctcgcgcaggagattccggtctgggctccggagctgtgcatcgagtgtggcaagtgctcgatggtctgcccgcacgctgccatccgcatcaaggtttacgagccgaagcacctcgaaaacgccccggcaaccttcaagagcctcgatgcgaaagcaaaaaactgggagggcatgcgctatacggttcagattgcaccggaagattgtaccggctgccaactctgcgtcaacgcctgccccgcaagagacaagcaggttgaaggccgcaaagcgctcaacatgcacgagcaggctccgctgcgcgaaaccgaatctgcctgctggagcttcttcatcaatctcccggaattcgaccgcaacaagatcaaccagcgcctcatcaaagagcagcagcttcagcagccactcttcgagttctcgggcgcatgctcgggctgcggcgaaacgccatacgtcaagctgatgactcagctcttcggtgatcgcctcgttatcggcaacgccaccggctgctcgtcgatctacggcggcaacctgccgaccacgccgtatgcagccaacccgcagggccttgggccaacgtggtcgaactcgcttttcgaggacacggcagagttcgcgcttggtttccggatatcgatcgacaagcagcagcaatttgccaaagagctggtcaaaaagctcgctggtgacatcggtgaaaaccttgccaccgccattctcaacgccacgcagaacagtgaaccggagattttcgagcagcgtgagcgcgtggccgtgctgaaggataagctccagcagatgaaatccgacgatgccaagaacctgcttgctgtggctgacatgctggtcaagaagagcgtgtgggctgtcggcggcgacggctgggcctacgatatcggttacgggggtctcgaccacgtcaccgcatcgggcaagaacgtcaacatgctcgtgctcgacaccgaggtctattccaataccggcggtcaggcctccaaggctacgccgaaagccgcgatcgccaagtttgccgctgcggggcgcatcgctaccaagaaagaccttggtctgatctcgatgagctacggcaatgcctatgtggccagtgttgcacttggcgcacgtgacgagcagacactcagagctttcatcgaagccgaggcgtacgatggcccgtcgattatcatcgcctactcgcactgcattgcacacggctttgacttgtctatgggtctggagcaccagaaagcagcggtcgattccggccactggctgctgtatcgctacaatcccgacagactcaaggagggactgaatccgctgcagctcgactccaaaaagccgaaaatgccggtcgcggagttcctgaacatggagaaccgcttcagaatactgaagaagacccaccccgatctggccaagaagtacttcgaggcaatccagcacgaggtcaatgcccgctgggcacactacgaacacctcgccaaccgttcgattgaaggcgaagcataa

SEQ ID NO: 60 - protein, 1185 aa, Chlorobium tepidum
MTRTFKTMEGNEALAHVAYRTNEVISIYPITPASPMGEYSDAWAAVDVKNIWGTVPLVNEMQSEAGAAAAVHGALQTGALTTTFTASQGLLLMIPNMYKIAGELTPCVIHVSARSLAAQALSIFCDHGDVMSVRGTGFALLASCSVQEVMDMALISQAATLESRVPFLHFFDGFRTSHEISKIEVLSDEQIRSMINDELVFAHRMRRMSPDAPIIRGTSQNPDVYFQARESVNKYYEACPSITQKAMDQFAKLTGRSYKLYQYYGAPDADRIIIMMGSGAETALETVEYLNNHGEKVGLVKVRLFRPFDVATFIASLPSSVKSIAVLDRVKEPGSAGEPLYLDVVNAVAESYQEGKCASMPSVLGGRYGLSSKEFTPAMVKAIFDNMNAESPKNHFTVGIDDDVTKKSLAYDETFSIEPDSVFRALFYGLGSDGTVGANKNSIKIIGENTDNYAQGFFVYDSKKAGSITTSHLRFGPEQIRSTYLITEAQFVGCHHWVFLEMIDVAKNLKQGGTLLINSAYAPDVVWSKLPRPVQQHLIDKQAKLYTIDAYKVAHESGMGQRINTIMQACFFAISGVLPREEAIEKIKDAIRHTYGKKGDEVVQQNIKAVDNTLANLHEVKIGAVADSTKELRSPIVGDAPEFVCNVLAKIIAGEGDSIPVSKLPADGTYPLGTTKFEKRNLAQEIPVWAPELCIECGKCSMVCPHAAIRIKVYEPKHLENAPATFKSLDAKAKNWEGMRYTVQIAPEDCTGCQLCVNACPARDKQVEGRKALNMHEQAPLRETESACWSFFINLPEFDRNKINQRLIKEQQLQQPLFEFSGACSGCGETPYVKLMTQLFGDRLVIGNATGCSSIYGGNLPTTPYAANPQGLGPTWSNSLFEDTAEFALGFRISIDKQQQFAKELVKKLAGDIGENLATAILNATQNSEPEIFEQRERVAVLKDKLQQMKSDDAKNLLAVADMLVKKSVWAVGGDGWAYDIGYGGLDHVTASGKNVNMLVLDTEVYSNTGGQASKATPKAAIAKFAAAGRIATKKDLGLISMSYGNAYVASVALGARDEQTLRAFIEAEAYDGPSIIIAYSHCIAHGFDLSMGLEHQKAAVDSGHWLLYRYNPDRLKEGLNPLQLDSKKPKMPVAEFLNMENRFRILKKTHPDLAKKYFEAIQHEVNARWAHYEHLANRSIEGEA

SEQ ID NO: 61 - DNA, 336 bp, Escherichia coli
  CDS (1)..(336)
atgccaaagattgttattttgcctcatcaggatctctgccctgatggcgctgttctggaagctaatagcggtgaaaccattctcgacgcagctctgcgtaacggtatcgagattgaacacgcctgtgaaaaatcctgtgcttgcaccacctgccactgcatcgttcgtgaaggttttgactcactgccggaaagctcagagcaggaagacgacatgctggacaaagcctggggactggagccggaaagccgtttaagctgccaggcgcgcgttaccgacgaagatttagtagtcgaaatcccgcgttacactatcaaccatgcgcgtgagcattaa

SEQ ID NO: 62 - protein, 111 aa, Escherichia coli
MPKIVILPHQDLCPDGAVLEANSGETILDAALRNGIEIEHACEKSCACTTCHCIVREGFDSLPESSEQEDDMLDKAWGLEPESRLSCQARVTDEDLVVEIPRYTINHAREH

SEQ ID NO: 63 - DNA, 261 bp, Escherichia coli
  CDS (1)..(261)
atggcgttgttaatcactaaaaaatgcatcaattgtgatatgtgtgaacccgaatgcccgaatgaggcgatttcaatgggagatcatatctacgagattaacagcgataagtgtaccgaatgcgtagggcactacgagacaccaacctgccagaaggtgtgcccgatccccaatactattgtgaaagatccggcgcatgtcgagacagaagaacagttgtgggataaatttgtgctgatgcaccacgcggataaaatttaa

SEQ ID NO: 64 - protein, 86 aa, Escherichia coli
MALLITKKCINCDMCEPECPNEAISMGDHIYEINSDKCTECVGHYETPTCQKVCPIPNTIVKDPAHVETEEQLWDKFVLMHHADKI

SEQ ID NO: 65 - DNA, 531 bp, Escherichia coli
  CDS (1)..(531)
atggctatcactggcatctttttcggcagcgacaccggtaataccgaaaatatcgcaaaaatgattcaaaaacagcttggtaaagacgttgccgatgtccatgacattgcaaaaagcagcaaagaagatctggaagcttatgacattctgctgctgggcatcccaacctggtattacggcgaagcgcagtgtgactgggatgacttcttcccgactctcgaagagattgatttcaacggcaaactggttgcgctgtttggttgtggtgaccaggaagattacgccgaatatttctgcgacgcattgggcaccatccgcgacatcattgaaccgcgcggtgcaaccatcgttggtcactggccaactgcgggctatcatttcgaagcatcaaaaggtctggcagatgacgaccactttgtcggtctggctatcgacgaagaccgtcagccggaactgaccgctgaacgtgtagaaaaatgggttaaacagatttctgaagagttgcatctcgacgaaattctcaatgcctga

SEQ ID NO: 66 - protein, 176 aa, Escherichia coli
MAITGIFFGSDTGNTENIAKMIQKQLGKDVADVHDIAKSSKEDLEAYDILLLGIPTWYYGEAQCDWDDFFPTLEEIDFNGKLVALFGCGDQEDYAEYFCDALGTIRDIIEPRGATIVGHWPTAGYHFEASKGLADDDHFVGLAIDEDRQPELTAERVEKWVKQISEELHLDEILNA

SEQ ID NO: 67 - DNA, 522 bp, Escherichia coli
  CDS (1)..(522)
atgaatatgggtcttttttacggttccagcacctgttacaccgaaatggcggcagaaaaaatccgcgatattatcggcccagaactggtgaccttacataacctcaaggacgactccccgaaattaatggagcagtacgatgtgctcattctgggtatcccgacctgggattttggtgaaatccaggaagactgggaagccgtctgggatcagctcgacgacctgaaccttgaaggtaaaattgttgcgctgtatgggcttggcgatcaactgggatacggcgagtggttcctcgatgcgctcggtatgctgcatgacaaactctcgaccaaaggcgtgaagttcgtcggctactggccaacggaaggatatgaatttaccagcccgaaaccggtgattgctgacgggcaactgttcgtgggtctggcgctggatgaaactaaccagtatgaccttagcgacgagcgtattcagagctggtgcgagcaaatcctcaacgaaatggcagagcattacgcctga

SEQ ID NO: 68 - protein, 173 aa, Escherichia coli
MNMGLFYGSSTCYTEMAAEKIRDIIGPELVTLHNLKDDSPKLMEQYDVLILGIPTWDFGEIQEDWEAVWDQLDDLNLEGKIVALYGLGDQLGYGEWFLDALGMLHDKLSTKGVKFVGYWPTEGYEFTSPKPVIADGQLFVGLALDETNQYDLSDERIQSWCEQILNEMAEHYA

SEQ ID NO: 69 - DNA, 189 bp, Chlorobium tepidum
  CDS (1)..(189)
atggcactgtatatcaccgaagaatgcacctactgcggtgcttgcgaacccgaatgcccgaccaacgctatctccgctggcagcgagatctacgttatcgatgccgcatcctgcaacgagtgcgccggttttgctgactctcctgcttgcgttgctgtctgcccggcagagtgcatcgttcagggctga

SEQ ID NO: 70 - protein, 62 aa, Chlorobium tepidum
MALYITEECTYCGACEPECPTNAISAGSEIYVIDAASCNECAGFADSPACVAVCPAECIVQG

SEQ ID NO: 71 - DNA, 189 bp, Chlorobium tepidum
  CDS (1)..(189)
atggcacaccgtattaccgatgaatgcacctactgtgcagcctgcgagccggaatgtccggtcagcgcgatctccgctggcgactctatttacgtgatcgacgagaatgtatgcgtggattgtatcggctatcacgacgagcctgcctgtgtggccgtctgcccggtggactgcattatcaaggtatag

SEQ ID NO: 72 - protein, 62 aa, Chlorobium tepidum
MAHRITDECTYCAACEPECPVSAISAGDSIYVIDENVCVDCIGYHDEPACVAVCPVDCIIKV

SEQ ID NO: 73 - DNA, 2808 bp, Pantoea ananatis
  CDS (1)..(2808)
atgcagaacagcgcgatgaagccctggctggactcctcctggctggccggcgcgaatcagtcttacatagagcaactctatgaggatttcctgaccgatcctgactctgtggatgcagtgtggcgctcgatgttccaacagttaccaggcacgggagtgaaacctgagcagttccactccgcaactcgcgaatatttccgtcgcctggcgaaagacgcatctcgttacacctcctcagttaccgatccggcaaccaactccaaacaagtgaaagtgctgcagctgattaacgcgtttcgtttccgcggacatcaggaagcaaatctcgatccgcttggcctgtggaaacaggaccgcgttgccgatctcgatcctgcctttcacgatctgaccgacgccgattttcaggaaagctttaacgtaggttcttttgccattggcaaagaaaccatgaagctggccgatctgttcgacgcgctgaagcagacctactgtggctcgattggtgcagagtatatgcacatcaataacaccgaagagaaacgctggatccagcagcgtatcgaatccggtgcgagccagacgtcattcagtggcgaagagaaaaaaggtttcctgaaagagctgaccgcggcagaagggctggaaaaatatctgggcgcgaaattcccgggtgcaaaacgtttctcgctggaaggcggtgatgcgctggtgccgatgctgcgcgagatgattcgtcatgcgggcaaaagcggcacacgtgaagtggtactggggatggcgcaccgtggccgtcttaacgtactgattaacgtactgggtaaaaagccacaggatctgttcgacgaattctccggtaaacacaaagagcatctgggcaccggtgatgtgaagtatcacatgggcttctcttcggatattgaaaccgaaggtggtctggtgcatctggcgctggcgtttaacccgtctcacctggaaattgtcagcccggtggtcatgggatcggtacgtgcacgtctcgatcgtctggccgaaccggtcagcaataaagtgttgcctatcaccattcacggtgatgcggcggtgattggtcagggcgtggttcaggaaaccctgaacatgtctcaggcgcgcggctacgaagtgggcggcacggtacgtatcgtcattaacaaccaggttggttttaccacctccaacccgaaagatgcgcgttcaaccccgtactgtactgacatcggcaagatggtgctggcaccgattttccacgtcaatgctgacgatccggaagcggtggcctttgttacccgcctggcgctggactatcgcaacaccttcaaacgcgatgtgtttatcgatctggtgtgctatcgccgtcatggtcacaacgaggcggatgagccaagtgctacccagccgttgatgtaccagaaaatcaaaaagcatccgacgccgcgtaaaatttacgccgatcgtctggaaggcgaaggtgtcgcgtcgcaggaagatgccaccgagatggtgaacctgtaccgcgatgcgctcgatgcgggcgaatgcgtggtgccggaatggcgtccgatgagcctgcactccttcacgtggtcgccttatctgaaccacgaatgggatgagccttatccggcacaggttgacatgaaacgcctgaaggaactggcattgcgtatcagccaggtccctgagcagattgaagtgcagtcgcgcgtggccaagatctataacgatcgcaagctgatggccgaaggcgagaaagcgttcgactggggcggtgccgagaatctggcgtacgccacgctggtggatgaaggtattccggttcgcctctcgggtgaagactccggtcgtggaaccttcttccatcgccacgcggtcgtgcacaaccaggctaacggttcaacctatacgccgctgcaccatattcataacagccagggcgagttcaaagtctgggattcggtgctgtctgaagaagcggtgctggcgtttgaatacggttacgccacggctgagccgcgcgtgctgaccatctgggaagcgcagtttggtgactttgccaacggtgctcaggtggtgattgaccagttcatcagctctggcgaacagaagtggggccgtatgtgtggcctggtgatgttgctgccgcatggctacgaaggtcagggaccggaacactcctctgcccgtctggaacgctatctgcaactttgcgccgagcagaacatgcaggtttgcgtcccgtcgacgccggctcaggtgtatcacatgctgcgccgtcaggcgctgcgcgggatgcgccgtccgctggtggtgatgtcgccgaagtcgctgttacgccatccactggcgatctcgtcgctggatgaactggcaaacggcagtttccagccggccattggtgagatcgacgatctggatccgcagggcgtgaaacgcgtcgtgctgtgctccggtaaggtttactacgatctgctggaacagcgtcgtaaagacgagaaaaccgatgttgccatcgtgcgcatcgaacagctttacccgttcccgcatcaggcggtacaggaagcattgaaagcctattctcacgtacaggactttgtctggtgccaggaagagcctctgaaccagggcgcctggtactgtagccagcatcatttccgtgatgtcgtgccgtttggtgccaccctgcgttatgcaggtcgcccggcatcggcttctccggccgtgggttatatgtccgtacaccaacaacagcagcaagacctggttaatgacgcactgaacgtcaattaa

SEQ ID NO: 74 - protein, 935 aa, Pantoea ananatis
MQNSAMKPWLDSSWLAGANQSYIEQLYEDFLTDPDSVDAVWRSMFQQLPGTGVKPEQFHSATREYFRRLAKDASRYTSSVTDPATNSKQVKVLQLINAFRFRGHQEANLDPLGLWKQDRVADLDPAFHDLTDADFQESFNVGSFAIGKETMKLADLFDALKQTYCGSIGAEYMHINNTEEKRWIQQRIESGASQTSFSGEEKKGFLKELTAAEGLEKYLGAKFPGAKRFSLEGGDALVPMLREMIRHAGKSGTREVVLGMAHRGRLNVLINVLGKKPQDLFDEFSGKHKEHLGTGDVKYHMGFSSDIETEGGLVHLALAFNPSHLEIVSPVVMGSVRARLDRLAEPVSNKVLPITIHGDAAVIGQGVVQETLNMSQARGYEVGGTVRIVINNQVGFTTSNPKDARSTPYCTDIGKMVLAPIFHVNADDPEAVAFVTRLALDYRNTFKRDVFIDLVCYRRHGHNEADEPSATQPLMYQKIKKHPTPRKIYADRLEGEGVASQEDATEMVNLYRDALDAGECVVPEWRPMSLHSFTWSPYLNHEWDEPYPAQVDMKRLKELALRISQVPEQIEVQSRVAKIYNDRKLMAEGEKAFDWGGAENLAYATLVDEGIPVRLSGEDSGRGTFFHRHAVVHNQANGSTYTPLHHIHNSQGEFKVWDSVLSEEAVLAFEYGYATAEPRVLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLVVMSPKSLLRHPLAISSLDELANGSFQPAIGEIDDLDPQGVKRVVLCSGKVYYDLLEQRRKDEKTDVAIVRIEQLYPFPHQAVQEALKAYSHVQDFVWCQEEPLNQGAWYCSQHHFRDVVPFGATLRYAGRPASASPAVGYMSVHQQQQQDLVNDALNVN

SEQ ID NO: 75 - DNA, 1224 bp, Pantoea ananatis
  CDS (1)..(1224)
atgagtagcgtagatattctcgttcccgacctgcctgaatcggttgcagatgccacagtagcaacctggcacaagaaaccaggcgatgcagtcagccgcgatgaagtcatcgtcgaaattgaaactgacaaagtcgtgctggaagtgccggcatctgccgatggcgtgctggaagccgtgctggaagacgaaggggcaaccgttacgtcccgccagatcctgggtcgcctgaaagaaggcaacagtgcgggtaaagaaagcagtgccaaagcggaaagcaatgacaccacgccagcccagcgtcagacagcgtcgcttgaagaagagagcagcgatgcgctcagcccggcgatccgtcgcctgattgcggagcataatcttgacgctgcgcagatcaaaggcaccggcgtaggcggacgtttaacgcgtgaagacgttgaaaaacatctggcgaacaaaccgcaggctgagaaagccgccgcgccagcggcgggtgcagcaacggctcagcagcctgttgccaaccgcagcgaaaaacgtgttccgatgacgcgtttacgtaagcgcgtcgcggagcgtctgctggaagccaagaacagcaccgccatgttgacgaccttcaacgaaatcaacatgaagccgattatggatctgcgtaagcagtacggcgatgcgttcgagaagcgtcacggtgtgcgtctgggctttatgtctttctacatcaaggccgtggtcgaagcgctgaagcgttatccagaagtcaacgcctctatcgatggcgaagacgtggtgtaccacaactatttcgatgtgagtattgccgtctctacgccacgcggactggtgacgcctgtcctgcgtgacgttgatgcgctgagcatggctgacatcgagaagaaaattaaagaactggcagtgaaaggccgtgacggcaagctgacggttgacgatctgacgggcggtaactttaccatcaccaacggtggtgtgttcggttcgctgatgtctacgccaatcatcaacccgccacagagcgcgattctgggcatgcacgccattaaagatcgtcctatggcggtcaatggtcaggttgtgatcctgccaatgatgtacctggctctctcctacgatcaccgtttaatcgatggtcgtgaatctgtcggctatctggtcgcggtgaaagagatgctggaagatccggcgcgtctgctgctggatgtctga

SEQ ID NO: 76 - protein, 407 aa, Pantoea ananatis
MSSVDILVPDLPESVADATVATWHKKPGDAVSRDEVIVEIETDKVVLEVPASADGVLEAVLEDEGATVTSRQILGRLKEGNSAGKESSAKAESNDTTPAQRQTASLEEESSDALSPAIRRLIAEHNLDAAQIKGTGVGGRLTREDVEKHLANKPQAEKAAAPAAGAATAQQPVANRSEKRVPMTRLRKRVAERLLEAKNSTAMLTTFNEINMKPIMDLRKQYGDAFEKRHGVRLGFMSFYIKAVVEALKRYPEVNASIDGEDVVYHNYFDVSIAVSTPRGLVTPVLRDVDALSMADIEKKIKELAVKGRDGKLTVDDLTGGNFTITNGGVFGSLMSTPIINPPQSAILGMHAIKDRPMAVNGQVVILPMMYLALSYDHRLIDGRESVGYLVAVKEMLEDPARLLLDV

SEQ ID NO: 77 - DNA, 1425 bp, Pantoea ananatis
  CDS (1)..(1425)
atgagtacagagattaaaactcaggtcgtggtacttggggcaggtcctgcaggttactctgcagcttttcgttgcgctgacttaggtctggaaaccgtactggttgagcgctacagcaccctcggcggtgtctgtcttaacgtaggctgtatcccgtctaaagcgctactgcacgttgccaaagtgattgaagaagcgaaagcgctggaagaacacggcattgtgtttggtcagccgcaaacggatatcaacaaaatccgcagctggaaagagaaggtgattaaccagctgactggcggtctgtcaggcatggcaaaaggtcgtaaagtcaaggttgttaacggcctgggcaaatttaccggtgcgaatacgctggtggttgaaggtgaaggtggtgcaaccaccattaacttcgacaacgccattatcgctgcgggctcacgcccaatcgagctgccgttcattcctcatgaagatcctcgcgtgtgggattcaaccgatgcgctggaactgaaagaagtgcctaaacgtctgctggtcatgggcggcggtattatcggtctggaaatggcgacggtttaccatgcgctgggttcagagatcgacgtggttgaaatgttcgaccaggttatcccggctgccgataaagacgtggtgaaagtcttcaccaaacgtatcagcaagaaattcaacctgatgctggaaactaaggtgaccgccgttgaagcaaaagacgacggtatctatgtttcaatggaaggtaaacaagcgccaggcgaagcccagcgttatgatgcggttctggtggcaattggtcgcgtgccaaacggtaagggcatggatgcagataaagccggcgttgaggttgacgaccgtggctttatccgcgttgacaaacaaatgcgcaccaacgtgccgcacatctacgctatcggcgatatcgtcgggcagccgatgctggcgcataaaggcgtgcatgaaggccacgttgcggcagaagtcatttcaggtctgaagcactacttcgatccgaaagtgattccgtccattgcctatactgaaccagaagttgcctgggttggtctgaccgagaaagaagcgaaagagaaaggcatcagctatgaaactgccacattcccgtgggcagcatccggccgtgctattgcttctgactgcgcagacggtatcaccaaactgattttcgacaaagaaacccatcgcgttatcggtggcgccatcgtcggtactaacggcggtgagctgctgggcgaaattggtctggccatcgagatgggctgtgatgcagaagacatcgcattgaccatccatgcgcacccgaccctgcatgagtcagtaggcctggccgctgaaatctttgaaggcagcatcaccgatctgcctaacgcgaaagcgaaaaagaaataa

SEQ ID NO: 78 - protein, 474 aa, Pantoea ananatis
MSTEIKTQVVVLGAGPAGYSAAFRCADLGLETVLVERYSTLGGVCLNVGCIPSKALLHVAKVIEEAKALEEHGIVFGQPQTDINKIRSWKEKVINQLTGGLSGMAKGRKVKVVNGLGKFTGANTLVVEGEGGATTINFDNAIIAAGSRPIELPFIPHEDPRVWDSTDALELKEVPKRLLVMGGGIIGLEMATVYHALGSEIDVVEMFDQVIPAADKDVVKVFTKRISKKFNLMLETKVTAVEAKDDGIYVSMEGKQAPGEAQRYDAVLVAIGRVPNGKGMDADKAGVEVDDRGFIRVDKQMRTNVPHIYAIGDIVGQPMLAHKGVHEGHVAAEVISGLKHYFDPKVIPSIAYTEPEVAWVGLTEKEAKEKGISYETATFPWAASGRAIASDCADGITKLIFDKETHRVIGGAIVGTNGGELLGEIGLAIEMGCDAEDIALTIHAHPTLHESVGLAAEIFEGSITDLPNAKAKKK

SEQ ID NO: 79 - DNA, 3666 bp, Corynebacterium glutamicum
  CDS (1)..(3666)
gtgagcagcgctagtactttcggccagaatgcgtggctggtagacgagatgttccagcagttccagaaggaccccaagtccgtggacaaggaatggagagaactctttgaggcgcaggggggaccaaatactacccccgctacaacagaagcacagccttcagcgcccaaggagtctgcgaaaccagcaccaaaggctgcccctgcagccaaggcagcaccgcgcgtagaaaccaagccggccgacaagaccgcccctaaggccaaggagtcctcagtgccacagcaacctaagcttccggagccaggacaaaccccaatcaggggtattttcaagtccatcgcgaagaacatggatatctccctggaaatcccaaccgcaacctcggttcgcgatatgccagctcgcctcatgttcgaaaaccgcgcgatggtcaacgatcagctcaagcgcacccgcggtggcaagatctccttcacccacatcattggctacgccatggtgaaggcagtcatggctcacccggacatgaacaactcctacgacgtcatcgacggcaagccaaccctgatcgtgcctgagcacatcaacctgggccttgctatcgaccttcctcagaaggacggctcccgcgcacttgtcgtagcagccatcaaggaaaccgagaagatgaacttctccgagttcctcgcagcctacgaagacatcgtggcacgctcccgcaagggcaagctcaccatggatgactaccagggcgttaccgtttccttgaccaacccaggtggcatcggtacccgccactctgttccacgtctaaccaagggccagggcaccatcatcggtgtcggttccatggattacccagcagagttccagggcgcttcagaagaccgccttgcagagctcggcgttggcaaacttgtcaccatcacctccacctacgatcaccgcgtgatccagggtgctgtgtccggtgaattcctgcgcaccatgtctcgcctgctcaccgatgattccttctgggatgagatcttcgacgcaatgaacgttccttacaccccaatgcgttgggcacaggacgttccaaacaccggtgttgataagaacacccgcgtcatgcagctcattgaggcataccgctcccgtggacacctcatcgctgacaccaacccactttcatgggttcagcctggcatgccagttccagaccaccgcgacctcgacatcgagacccacaacctgaccatctgggatctggaccgtaccttcaacgtcggtggcttcggcggcaaggagaccatgaccctgcgcgaggtactgtcccgcctccgcgctgcgtacaccctcaaggtcggctccgaatacacccacatcctggaccgcgacgagcgcacctggctgcaggaccgcctcgaggccggaatgccaaagccaacccaggcagagcagaagtacatcctgcagaagctgaacgccgcggaggctttcgagaacttcctgcagaccaagtacgtcggccagaagcgcttctccctcgaaggtgcagaagcacttatcccactgatggactccgccatcgacaccgccgcaggccaaggcctcgacgaagttgtcatcggtatgccacaccgtggtcgcctcaacgtgctgttcaacatcgtgggcaagccactggcatccatcttcaacgagtttgaaggccaaatggagcagggccagatcggtggctccggtgacgtgaagtaccacctcggttccgaaggccagcacctgcagatgttcggcgacggcgagatcaaggtctccctgactgctaacccgtcccacctggaagctgttaacccagtgatggaaggtatcgtccgcgcaaagcaggactacctggacaagggcgtagacggcaagactgttgtgccactgctgctccacggtgacgctgcattcgcaggcctgggcatcgtgccagaaaccatcaacctggctaagctgcgtggctacgacgtcggcggcaccatccacatcgtggtgaacaaccagatcggcttcaccaccaccccagactccagccgctccatgcactacgcaaccgactacgccaaggcattcggctgcccagtcttccacgtcaacggcgacgacccagaggcagttgtctgggttggccagctggccaccgagtaccgtcgtcgcttcggcaaggacgtcttcatcgacctcgtctgctaccgcctccgcggccacaacgaagctgatgatccttccatgacccagccaaagatgtatgagctcatcaccggccgcgagaccgttcgtgctcagtacaccgaagacctgctcggacgtggagacctctccaacgaagatgcagaagcagtcgtccgcgacttccacgaccagatggaatctgtgttcaacgaagtcaaggaaggcggcaagaagcaggctgaggcacagaccggcatcaccggctcccagaagcttccacacggccttgagaccaacatctcccgtgaagagctcctggaactgggacaggctttcgccaacaccccagaaggcttcaactaccacccacgtgtggctcccgttgctaagaagcgcgtctcctctgtcaccgaaggtggcatcgactgggcatggggcgagctcctcgccttcggttccctggctaactccggccgcttggttcgccttgcaggtgaagattcccgccgcggtaccttcacccagcgccacgcagttgccatcgacccagcgaccgctgaagagttcaacccactccacgagcttgcacagtccaagggcaacaacggtaagttcctggtctacaactccgcactgaccgagtacgcaggcatgggcttcgagtacggctactccgtaggaaacgaagactccatcgttgcatgggaagcacagttcggcgacttcgccaacggcgctcagaccatcatcgatgagtacgtctcctcaggcgaagctaagtggggccagacctccaagctgatccttctgctgcctcacggctacgaaggccagggcccagaccactcttccgcacgtatcgagcgcttcctgcagctgtgcgctgagggttccatgactgttgctcagccatccaccccagcaaaccacttccacctactgcgtcgtcacgctctgtccgacctgaagcgtccactggttatcttcaccccgaagtccatgctgcgtaacaaggctgctgcctccgcaccagaagacttcactgaggtcaccaagttccagtccgtgatcaacgatccaaacgttgcagatgcagccaaggtgaagaaggtcatgctggtctccggcaagctgtactacgaattggcaaagcgcaaggagaaggacggacgcgacgacatcgcgatcgttcgtatcgaaatgctccacccaattccgttcaaccgcatctccgaggctcttgccggctaccctaacgctgaggaagtcctcttcgttcaggatgagccagcaaaccagggcccatggccgttctaccaggagcacctcccagagctgatcccgaacatgccaaagatgcgccgcgtttcccgccgcgctcagtcctccaccgcaactggtgttgccaaggtgcaccagctggaggagaagcagcttatcgacgaggctttcgaggcttaa

SEQ ID NO: 80 - protein, 1221 aa, Corynebacterium glutamicum
MSSASTFGQNAWLVDEMFQQFQKDPKSVDKEWRELFEAQGGPNTTPATTEAQPSAPKESAKPAPKAAPAAKAAPRVETKPADKTAPKAKESSVPQQPKLPEPGQTPIRGIFKSIAKNMDISLEIPTATSVRDMPARLMFENRAMVNDQLKRTRGGKISFTHIIGYAMVKAVMAHPDMNNSYDVIDGKPTLIVPEHINLGLAIDLPQKDGSRALVVAAIKETEKMNFSEFLAAYEDIVARSRKGKLTMDDYQGVTVSLTNPGGIGTRHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHNLTIWDLDRTFNVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPVMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSIVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVINDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 81 - DNA, 1410 bp, Corynebacterium glutamicum
  CDS (1)..(1410)
gtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttctag

SEQ ID NO: 82 - protein, 469 aa, Corynebacterium glutamicum
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 83 - DNA, 2028 bp, Corynebacterium glutamicum
  CDS (1)..(2028)
atggcgttctccgtagagatgcccgagctgggcgaatcagtaaccgaaggcacgatcacccagtggttgaagtctgttggtgacactgttgaggtagatgagccgttgctcgaggtctcaactgacaaggtcgacaccgagattccctctcctgtcgccggtgtcatcctagagattaaggctgaagaggatgacaccgtcgacgtcggcggtgtcattgcaataatcggcgatgctgatgagactcctgccaacgaagctcctgccgacgaggcaccagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttccatacgtcaccccactggtgcgcaagcttgctgaaaagcacggcgttgacttgaacaccgtgaccggtaccggtatcggtggccgtatccgcaagcaggatgttttggctgctgcgaacggcgaggctgcacctgctgaggctgctgctcctgtttccgcttggtccactaagtctgttgaccctgagaaggctaagctccgtggtaccactcagaaggtcaaccgcatccgtgagatcaccgcgatgaagaccgtcgaggctctgcagatttctgctcagctcacccagctgcacgaggtcgatatgactcgcgttgctgagctgcgtaagaagaacaagcccgcgttcatcgagaagcacggtgtgaacctcacttacctgccattcttcgtgaaggcagttgtcgaggctttggtttcccatccaaacgtcaacgcgtctttcaacgcgaagaccaaggagatgacctaccactcctccgttaacctctccatcgctgttgataccccagctggtctgttgaccccagtcattcacgatgctcaggatctctccatcccagagatcgcaaaggcaattgttgacctggctgatcgttcacgcaacaacaagctgaagccaaacgatctgtccggtggcaccttcaccatcaccaacattggttctgaaggcgcactgtctgataccccaatcctggttccaccacaggctggcatcttgggcaccggcgcgatcgtgaagcgtccagttgtcatcaccgaggatggaattgattccatcgcgatccgtcagatggtcttcctaccactgacctacgaccaccaggttgtagatggcgcagatgctggtcgcttcctgaccaccatcaaggaccgccttgagaccgctaacttcgaaggcgatctgcagctctaa

SEQ ID NO: 84 - protein, 675 aa, Corynebacterium glutamicum
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

SEQ ID NO: 85 - DNA, 1404 bp, Corynebacterium glutamicum
  CDS (1)..(1404)
atgtcagttaacccaacccgccccgaaggcggccgtcaccacgtcgtcgtcatcggttctggttttggtggcctttttgctgccaagaacctggccaaggcagacgtcgatgtcactctgattgaccgcaccaaccaccacctcttccagccactgctgtaccaagtggcaaccggtatcctctcctccggtgaaatcgcaccttccactcgacagatcctgggctcccaggaaaacgtcaacgtcatcaagggcgaagtcaccgacatcaacgtcgagtcccagactgtgaccgcctccctgggcgagttcacccgcgtttttgagtacgattccttggtcgttggtgctggcgcaggtcagtcctacttcggcaatgatcacttcgctgagttcgcacctggcatgaagtccatcgacgatgcactggagattcgtgcacgcatcatcggtgctttcgagcgcgctgagatctgcgaggatccagctgagcgcgaacgcctgctcaccttcgtcgttgttggcgctggcccaaccggtgttgagcttgctggccagttggctgagatggctcaccgcacccttgctggtgagtacaagaacttcaacaccaactccgcaaagatcatcctgcttgatggtgctccacaggttcttcctccattcggtaagcgcctaggccgcaacgcacagcgcaccctggaaaagatgggtgtcaacgttcgcctgaacgctatggtcaccaacgttgacgctacctcggtcacctacaagaccaaggacggcgaagagcacaccatcgaatctttctgcaagatttggtccgctggtgttgcggcatccccactgggcaagctcgtcgcagagcagaccggtgttgagaccgaccgcgcaggccgcgtcatggttaacgatgacctgtctgttggcgatcagaagaacgtcttcgttgttggcgacatgatgaactacaacaacctccctggtgttgctcaggtagcaatccagagtggtgagtacgttgctgagcagatcgaagctgaggttgaaggccgctccaacaccgagcgcgaagctttcgattacttcgacaagggctccatggctaccatttcccgcttctccgcagtggtgaagatgggcaaggttgaggtcaccggcttcatcggttgggttctgtggttggctgttcacatcatgttcctggttggcttccgcaaccgtttcgtctccgcaatcagctggggcctgaacgcactgtcccgcaagcgttggaacctggcaaccacccgccagcagctccactcacgcaccacgctgtccaagttcgctcacgagcttgaggaagcatcttctgatcttccaatcgagctgcgcgacaaccagcgtttcagcggaaagtaa

SEQ ID NO: 86 - protein, 467 aa, Corynebacterium glutamicum
MSVNPTRPEGGRHHVVVIGSGFGGLFAAKNLAKADVDVTLIDRTNHHLFQPLLYQVATGILSSGEIAPSTRQILGSQENVNVIKGEVTDINVESQTVTASLGEFTRVFEYDSLVVGAGAGQSYFGNDHFAEFAPGMKSIDDALEIRARIIGAFERAEICEDPAERERLLTFVVVGAGPTGVELAGQLAEMAHRTLAGEYKNFNTNSAKIILLDGAPQVLPPFGKRLGRNAQRTLEKMGVNVRLNAMVTNVDATSVTYKTKDGEEHTIESFCKIWSAGVAASPLGKLVAEQTGVETDRAGRVMVNDDLSVGDQKNVFVVGDMMNYNNLPGVAQVAIQSGEYVAEQIEAEVEGRSNTEREAFDYFDKGSMATISRFSAVVKMGKVEVTGFIGWVLWLAVHIMFLVGFRNRFVSAISWGLNALSRKRWNLATTRQQLHSRTTLSKFAHELEEASSDLPIELRDNQRFSGK

SEQ ID NO: 87 - DNA, 1503 bp, Corynebacterium glutamicum
  CDS (1)..(1503)
atgtcagattccccgaagaacgcaccgaggattaccgatgaggcagatgtagttctcattggtgccggtatcatgagctccacgctgggtgcaatgctgcgtcagctggagccaagctggactcagatcgtcttcgagcgtttggatggaccggcacaagagtcgtcctccccgtggaacaatgcaggaaccggccactctgctctatgcgagctgaactacaccccagaggttaagggcaaggttgaaattgccaaggctgtaggaatcaacgagaagttccaggtttcccgtcagttctggtctcacctcgttgaagagggagtgctgtctgatcctaaggaattcatcaaccctgttcctcacgtatctttcggccagggcgcagatcaggttgcatacatcaaggctcgctacgaagctttgaaggatcacccactcttccagggcatgacctacgctgacgatgaagctaccttcaccgagaagctgcctttgatggcaaagggccgtgacttctctgatccagtagcaatctcttggatcgatgaaggcaccgacatcaactacggtgctcagaccaagcagtacctggatgcagctgaagttgaaggcactgaaatccgctatggccacgaagtcaagagcatcaaggctgatggcgcaaagtggatcgtgaccgtcaagaacgtacacactggcgacaccaagaccatcaaggcaaacttcgtgttcgtcggcgcaggcggatacgcactggatctgcttcgcagcgcaggcatcccacaggtcaagggcttcgctggattcccagtatccggcctgtggcttcgttgcaccaacgaggaactgatcgagcagcacgcagccaaggtatatggcaaggcatctgttggcgctcctccaatgtctgttcctcaccttgacacccgcgttatcgagggtgaaaagggtctgctctttggaccttacggtggctggacccctaagttcttgaaggaaggctcctacctggacctgttcaagtccatccgcccagacaacattccttcctaccttggcgttgctgctcaggaatttgatctgaccaagtaccttgtcactgaagttctcaaggaccaggacaagcgtatggatgctcttcgcgagtacatgccagaggcacaaaacggcgattgggagaccatcgttgccggacagcgtgttcaggttattaagcctgcaggattccctaagttcggttccctggaattcggcaccaccttgatcaacaactccgaaggcaccatcgccggattgctcggtgcttcccctggagcatccatcgcaccttccgcaatgatcgagctgcttgagcgttgcttcggtgaccgcatgatcgagtggggcgacaagctgaaggacatgatcccttcctacggcaagaagcttgcttccgagccagcactgtttgagcagcagtgggcacgcacccagaagaccctgaagcttgaggaagcctaa

SEQ ID NO: 88 - protein, 500 aa, Corynebacterium glutamicum
MSDSPKNAPRITDEADVVLIGAGIMSSTLGAMLRQLEPSWTQIVFERLDGPAQESSSPWNNAGTGHSALCELNYTPEVKGKVEIAKAVGINEKFQVSRQFWSHLVEEGVLSDPKEFINPVPHVSFGQGADQVAYIKARYEALKDHPLFQGMTYADDEATFTEKLPLMAKGRDFSDPVAISWIDEGTDINYGAQTKQYLDAAEVEGTEIRYGHEVKSIKADGAKWIVTVKNVHTGDTKTIKANFVFVGAGGYALDLLRSAGIPQVKGFAGFPVSGLWLRCTNEELIEQHAAKVYGKASVGAPPMSVPHLDTRVIEGEKGLLFGPYGGWTPKFLKEGSYLDLFKSIRPDNIPSYLGVAAQEFDLTKYLVTEVLKDQDKRMDALREYMPEAQNGDWETIVAGQRVQVIKPAGFPKFGSLEFGTTLINNSEGTIAGLLGASPGASIAPSAMIELLERCFGDRMIEWGDKLKDMIPSYGKKLASEPALFEQQWARTQKTLKLEEA

SEQ ID NO: 89 - DNA, 2283 bp, Escherichia coli
  CDS (1)..(2283)
atgtccgagcttaatgaaaagttagccacagcctgggaaggttttaccaaaggtgactggcagaatgaagtaaacgtccgtgacttcattcagaaaaactacactccgtacgagggtgacgagtccttcctggctggcgctactgaagcgaccaccaccctgtgggacaaagtaatggaaggcgttaaactggaaaaccgcactcacgcgccagttgactttgacaccgctgttgcttccaccatcacctctcacgacgctggctacatcaacaagcagcttgagaaaatcgttggtctgcagactgaagctccgctgaaacgtgctcttatcccgttcggtggtatcaaaatgatcgaaggttcctgcaaagcgtacaaccgcgaactggatccgatgatcaaaaaaatcttcactgaataccgtaaaactcacaaccagggcgtgttcgacgtttacactccggacatcctgcgttgccgtaaatctggtgttctgaccggtctgccagatgcatatggccgtggccgtatcatcggtgactaccgtcgcgttgcgctgtacggtatcgactacctgatgaaagacaaactggcacagttcacttctctgcaggctgatctggaaaacggcgtaaacctggaacagactatccgtctgcgcgaagaaatcgctgaacagcaccgcgctctgggtcagatgaaagaaatggctgcgaaatacggctacgacatctctggtccggctaccaacgctcaggaagctatccagtggacttacttcggctacctggctgctgttaagtctcagaacggtgctgcaatgtccttcggtcgtacctccaccttcctggatgtgtacatcgaacgtgacctgaaagctggcaagatcaccgaacaagaagcgcaggaaatggttgaccacctggtcatgaaactgcgtatggttcgcttcctgcgtactccggaatacgatgaactgttctctggcgacccgatctgggcaaccgaatctatcggtggtatgggcctcgacggtcgtaccctggttaccaaaaacagcttccgtttcctgaacaccctgtacaccatgggtccgtctccggaaccgaacatgaccattctgtggtctgaaaaactgccgctgaacttcaagaaattcgccgctaaagtgtccatcgacacctcttctctgcagtatgagaacgatgacctgatgcgtccggacttcaacaacgatgactacgctattgcttgctgcgtaagcccgatgatcgttggtaaacaaatgcagttcttcggtgcgcgtgcaaacctggcgaaaaccatgctgtacgcaatcaacggcggcgttgacgaaaaactgaaaatgcaggttggtccgaagtctgaaccgatcaaaggcgatgtcctgaactatgatgaagtgatggagcgcatggatcacttcatggactggctggctaaacagtacatcactgcactgaacatcatccactacatgcacgacaagtacagctacgaagcctctctgatggcgctgcacgaccgtgacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtaacaatgatccgcgtgtagatgacctggctgttgacctggtagaacgtttcatgaagaaaattcagaaactgcacacctaccgtgacgctatcccgactcagtctgttctgaccatcacttctaacgttgtgtatggtaagaaaacgggtaacaccccagacggtcgtcgtgctggcgcgccgttcggaccgggtgctaacccgatgcacggtcgtgaccagaaaggtgcagtagcctctctgacttccgttgctaaactgccgtttgcttacgctaaagatggtatctcctacaccttctctatcgttccgaacgcactgggtaaagacgacgaagttcgtaagaccaacctggctggtctgatggatggttacttccaccacgaagcatccatcgaaggtggtcagcacctgaacgttaacgtgatgaaccgtgaaatgctgctcgacgcgatggaaaacccggaaaaatatccgcagctgaccatccgtgtatctggctacgcagtacgtttcaactcgctgactaaagaacagcagcaggacgttattactcgtaccttcactcaatctatgtaa

SEQ ID NO: 90 - protein, 760 aa, Escherichia coli
MSELNEKLATAWEGFTKGDWQNEVNVRDFIQKNYTPYEGDESFLAGATEATTTLWDKVMEGVKLENRTHAPVDFDTAVASTITSHDAGYINKQLEKIVGLQTEAPLKRALIPFGGIKMIEGSCKAYNRELDPMIKKIFTEYRKTHNQGVFDVYTPDILRCRKSGVLTGLPDAYGRGRIIGDYRRVALYGIDYLMKDKLAQFTSLQADLENGVNLEQTIRLREEIAEQHRALGQMKEMAAKYGYDISGPATNAQEAIQWTYFGYLAAVKSQNGAAMSFGRTSTFLDVYIERDLKAGKITEQEAQEMVDHLVMKLRMVRFLRTPEYDELFSGDPIWATESIGGMGLDGRTLVTKNSFRFLNTLYTMGPSPEPNMTILWSEKLPLNFKKFAAKVSIDTSSLQYENDDLMRPDFNNDDYAIACCVSPMIVGKQMQFFGARANLAKTMLYAINGGVDEKLKMQVGPKSEPIKGDVLNYDEVMERMDHFMDWLAKQYITALNIIHYMHDKYSYEASLMALHDRDVIRTMACGIAGLSVAADSLSAIKYAKVKPIRDEDGLAIDFEIEGEYPQFGNNDPRVDDLAVDLVERFMKKIQKLHTYRDAIPTQSVLTITSNVVYGKKTGNTPDGRRAGAPFGPGANPMHGRDQKGAVASLTSVAKLPFAYAKDGISYTFSIVPNALGKDDEVRKTNLAGLMDGYFHHEASIEGGQHLNVNVMNREMLLDAMENPEKYPQLTIRVSGYAVRFNSLTKEQQQDVITRTFTQSM

SEQ ID NO: 91 - DNA, 2298 bp, Escherichia coli
  CDS (1)..(2298)
atgacgaatcgtatctctcgcctcaaaactgcactgtttgccaatacccgtgaaatctcgctggagcgggcgctgctttataccgccagccatcggcaaaccgaaggcgaaccggtgatattgcgccgggcgaaagcaacagcgtatatccttgaacatgttgaaatttcgattcgtgatgaagaactgattgccggtaaccgcaccgtaaaaccgcgcgccgggattatgtcgccggaaatggacccttactggctgctgaaagagctggatcaattcccgacgcgtccgcaggaccgctttgctatcagcgaagaagataaacgtatctaccgtgaagagttgttcccgtactgggaaaaacgttcgatgaaagatttcatcaacgggcagatgacagatgaagtaaaagccgcgaccaacacgcagattttcagcatcaaccagacggataaaggccaggggcacattattattgattacccacgcctgttgaatcacgggctgggtgagctggtggcacagatgcagcaacattgtcagcaacagccggagaatcacttttatcaggccgcgttgttactgctggaagcctcgcagaaacacattttgcgttacgccgaactggcggaaacgatggcggcaaactgcacagatgcccagcgtcgcgaagagctgctgactattgcagagatctcccgccataacgcgcaacataagccgcagacgttctggcaggcgtgccagttattctggtacatgaacatcattctgcaatacgaatccaacgccagttcgctatcgttggggcgcttcgaccagtatatgttgccgttctatcagacatcattaacccagggcgaagatgcggcgttcctgaaagaactgctcgaatctttatgggtgaaatgcaacgacatcgtgctgttgcgctccaccagtagcgcgcgttatttcgccggtttcccgaccggctataccgcactgctcggcgggttaaccgagaacggacgtagcgcggtgaacgtgctttcgttcctttgccttgacgcctatcaaagcgtgcaattaccgcaaccgaacctcggcgtgcgcactaacgccttgatcgacacgccgttcctgatgaaaaccgccgaaaccattcgcttcggtaccggtattccgcaaatctttaacgatgaagtggtggtgccagcgttcctcaaccgtggcgtttcgctggaagatgcgcgcgactattccgtagtgggctgtgtggaattatctattcccggcagaacctacggcttgcatgacatcgcgatgtttaatctgctgaaagtgatggaaatctgcctgcatgaaaatgaaggcaatgctgcgctgacttatgaaggtttactggagcagatccgcgccaagatcagccactacatcaccctgatggttgagggcagcaatatttgtgatatcggccatcgcgactgggcacctgtaccgctgctctcatcgtttatcagcgattgtctggaaaaaggccgcgatattaccgatggcggcgcgcgttataacttctccggcgtacaggggatcggtatcgccaacctgagcgattctctccatgcgttgaaagggatggtttttgagcaacagcgtttaagttttgacgaattgctgtcggtattaaaagccaacttcgcaacgccagaaggcgaaaaagtccgcgctcgcttaattaaccgcttcgagaaatacggtaacgatatcgacgaggtggataacatcagcgccgaactgttgcgccactactgcaaagaagtggaaaaataccagaacccgcgcggcggctacttcacgccgggatcgtataccgtttctgctcacgtcccgttgggatcggtggttggcgcgacgccagacggtcgttttgccggagaacagctggcagacggcggcttgtcacccatgctgggccaggacgcacaagggccaacagcggtactgaagtcagtcagtaagctcgataacacgctgctgtctaacggtacgttgctgaacgtgaaattcactccggcgaccctggaaggtgaagcaggattacgcaaactggccgacttcttacgggcgtttacccagcttaagttacaacatattcagtttaacgtggtgaacgccgacacgttgcgggaagcgcaacagcgcccacaagattatgccgggctggtggtgcgcgttgccggatacagcgccttctttgtcgaactgtcgaaggagatccaggatgacatcatccgccggacagcgcatcagctgtaa

SEQ ID NO: 92 - protein, 765 aa, Escherichia coli
MTNRISRLKTALFANTREISLERALLYTASHRQTEGEPVILRRAKATAYILEHVEISIRDEELIAGNRTVKPRAGIMSPEMDPYWLLKELDQFPTRPQDRFAISEEDKRIYREELFPYWEKRSMKDFINGQMTDEVKAATNTQIFSINQTDKGQGHIIIDYPRLLNHGLGELVAQMQQHCQQQPENHFYQAALLLLEASQKHILRYAELAETMAANCTDAQRREELLTIAEISRHNAQHKPQTFWQACQLFWYMNIILQYESNASSLSLGRFDQYMLPFYQTSLTQGEDAAFLKELLESLWVKCNDIVLLRSTSSARYFAGFPTGYTALLGGLTENGRSAVNVLSFLCLDAYQSVQLPQPNLGVRTNALIDTPFLMKTAETIRFGTGIPQIFNDEVVVPAFLNRGVSLEDARDYSVVGCVELSIPGRTYGLHDIAMFNLLKVMEICLHENEGNAALTYEGLLEQIRAKISHYITLMVEGSNICDIGHRDWAPVPLLSSFISDCLEKGRDITDGGARYNFSGVQGIGIANLSDSLHALKGMVFEQQRLSFDELLSVLKANFATPEGEKVRARLINRFEKYGNDIDEVDNISAELLRHYCKEVEKYQNPRGGYFTPGSYTVSAHVPLGSVVGATPDGRFAGEQLADGGLSPMLGQDAQGPTAVLKSVSKLDNTLLSNGTLLNVKFTPATLEGEAGLRKLADFLRAFTQLKLQHIQFNVVNADTLREAQQRPQDYAGLVVRVAGYSAFFVELSKEIQDDIIRRTAHQL

SEQ ID NO: 93 - DNA, 2295 bp, Escherichia coli
  CDS (1)..(2295)
atgaaggtagatattgataccagcgataagctgtacgccgacgcatggcttggctttaaaggtacggactggaaaaacgaaattaatgtccgcgattttattcaacataactatacaccgtatgaaggcgatgaatctttcctcgccgaagcgacgcctgccaccacggaattgtgggaaaaagtaatggaaggcatccgtatcgaaaatgcaacccacgcgccggttgatttcgataccaatattgccaccacaattaccgctcatgatgcgggatatattaaccagccgctggaaaaaattgttggcctgcaaacggatgcgccgttgaaacgtgcgctacacccgttcggtggcattaatatgattaaaagttcattccacgcctatggccgagaaatggacagtgaatttgaatatctgtttaccgatctgcgtaaaacccataaccagggcgtatttgatgtttactcaccggatatgctgcgctgccgtaaatctggcgtgctgaccggtttaccagatggctatggccgtgggcgcattatcggtgactatcgccgcgtagcgctgtatggcatcagttatctggtacgtgaacgcgaactgcaatttgccgatctccagtctcgtctggaaaaaggcgaggatctggaagccaccatccgtctgcgtgaggagctggcagagcatcgtcatgcgctgttgcagattcaggaaatggcggcgaaatatggctttgatatctctcgcccggcgcagaatgcgcaggaagcggtgcagtggctctacttcgcttatctggcggcagtgaaatcgcaaaatggcggcgcgatgtcgctgggccgcacggcatcgttcctcgatatctacattgagcgcgactttaaagctggcgtactcaatgagcagcaggcacaggaactgatcgatcacttcatcatgaagatccgtatggtacgcttcctgcgtacaccggaatttgattcgctgttctccggcgacccaatctgggcgacggaagtgatcggcgggatggggctggacggtcgtacgctggtgaccaaaaactccttccgctatttgcacaccctgcacactatggggccggcaccggaacctaacctgaccattctttggtcggaagaattaccgattgccttcaaaaaatatgccgcgcaggtgtcgatcgtcacctcttccttgcagtatgaaaatgacgatctgatgcgtactgacttcaacagcgacgattacgcgattgcctgctgcgtcagcccaatggtgattggtaagcaaatgcagttctttggtgcacgcgctaacctggcgaaaacgctgctctacgcaattaacggcggggtggacgagaagctgaagattcaggtcgggccgaaaacagcaccgctgatggacgacgtgctggattacgacaaagtgatggacagcctcgatcacttcatggactggctggcggtgcagtacatcagcgcgctgaatatcattcactacatgcacgacaagtacagctacgaagcttcgctgatggcgctgcacgatcgtgatgtctatcgcactatggcatgcggcatcgcgggcctgtcggtggcgacggactccctgtctgccatcaaatatgcccgcgtgaaaccaatccgtgacgaaaacggcctggcggtggactttgaaatcgacggtgaatatccgcagtacggcaacaacgacgagcgcgtagacagcattgcctgcgacctggttgaacgctttatgaagaaaattaaagcgctgccaacctatcgcaacgccgtccctacccagtcgattctgactatcacttctaacgtggtgtacggccagaaaaccggtaatacgccggacggtcgtcgcgccggaacaccgttcgcgccgggcgctaacccgatgcatggtcgtgaccgcaaaggtgccgtggcctcattgacgtcggtggcgaaactgccgttcacctacgccaaagatgggatctcgtacaccttctcaatcgttcctgcggcgctgggcaaagaagatccagtacgtaaaaccaaccttgtcggcctgctggatgggtatttccaccacgaagcggatgtcgaaggcggtcaacacctcaacgtcaacgtaatgaatcgggaaatgctgctggatgccatcgagcacccggaaaaatatcctaacctgacaatccgtgtctctggctacgccgtgcgcttcaacgcactgacccgtgaacagcaacaggatgttatttcacgtacctttacccaggcgctctga

SEQ ID NO: 94 - protein, 764 aa, Escherichia coli
MKVDIDTSDKLYADAWLGFKGTDWKNEINVRDFIQHNYTPYEGDESFLAEATPATTELWEKVMEGIRIENATHAPVDFDTNIATTITAHDAGYINQPLEKIVGLQTDAPLKRALHPFGGINMIKSSFHAYGREMDSEFEYLFTDLRKTHNQGVFDVYSPDMLRCRKSGVLTGLPDGYGRGRIIGDYRRVALYGISYLVRERELQFADLQSRLEKGEDLEATIRLREELAEHRHALLQIQEMAAKYGFDISRPAQNAQEAVQWLYFAYLAAVKSQNGGAMSLGRTASFLDIYIERDFKAGVLNEQQAQELIDHFIMKIRMVRFLRTPEFDSLFSGDPIWATEVIGGMGLDGRTLVTKNSFRYLHTLHTMGPAPEPNLTILWSEELPIAFKKYAAQVSIVTSSLQYENDDLMRTDFNSDDYAIACCVSPMVIGKQMQFFGARANLAKTLLYAINGGVDEKLKIQVGPKTAPLMDDVLDYDKVMDSLDHFMDWLAVQYISALNIIHYMHDKYSYEASLMALHDRDVYRTMACGIAGLSVATDSLSAIKYARVKPIRDENGLAVDFEIDGEYPQYGNNDERVDSIACDLVERFMKKIKALPTYRNAVPTQSILTITSNVVYGQKTGNTPDGRRAGTPFAPGANPMHGRDRKGAVASLTSVAKLPFTYAKDGISYTFSIVPAALGKEDPVRKTNLVGLLDGYFHHEADVEGGQHLNVNVMNREMLLDAIEHPEKYPNLTIRVSGYAVRFNALTREQQQDVISRTFTQAL

SEQ ID NO: 95 - DNA, 2283 bp, Pantoea ananatis
  CDS (1)..(2283)
atgaccgaacttaacgcaaaactggcctcagcctggcagggttttactgaaggcgaatggcagaacagcgtcaacgtacgcgacttcatccagaaaaactatacgccgtatgaaggcaatgaatctttcctcgctggcgccaccgaagccaccactaaactgtgggaaagcgtgctggaaggcattaaagttgaaaaccgtacccacgcacccgtcgattttgataccgatcttgcttctaccatcacctcgcacgatgccggctatatcaataaatcgctggaaaaagttgttggcctgcaaacggaagcgccgctgaaacgcgccattattccttttggcggcattaagatggtcgagggttcatgcaaagtttacgggcgcgaactcgatgcttcactgaaaaaaatcttcaccgactatcgtaaaacgcacaatcagggcgtgtttgatgtttatacccctgacattttacgctgccgtaaatcaggtatattaaccggcctgcctgatgcctatggtcgtggacgcatcatcggtgactaccgtcgtatcgccttatacggcattgactacctgatggccgataagtttgctcagtttgcgtctctgcaaagcgatctggaaaatggcgtcaacctggaagccaccattcgtctacgcgaagaaattgctgaccagcatcgggcgcttggacaaatcaaagagatggcagccaaatatggtcacgatatctcaggtccggcgaccaatgcagtcgaagccgttcagtggacctattacggctatcttgccgcagtaaaatcacagaacggtgcagccatgtcctttggccgtgtttcaaccttcctggacgtgttcattgagcgcgatctcaacgccggtaagctgaacgaagcgcaggcgcaggaactgattgaccacctggtgatgaaactgcgcatggtccgcttcctgcgcacgcctgagtacgatgaactgttctctggcgaccccatctgggcaacggaatcgctggccggtatgggcgttgatggacgtacgctggtgagtaaaaccaccttccgtttcctcaatacactgtacaccatgggcccttcacctgagcctaatatgaccattctgtggtctgagaagctgccggttaactttaaaaagtatgcggcgaaagtgtctattgatacgtcatcattgcagtatgaaaacgacgacctgatgcgtcccgatttcgacaacgatgactatgcaattgcctgctgcgtcagcccaatgatcgtcggtaagcaaatgcagttcttcggtgcccgcgccaacctggcgaaaaccctgctctacgcaatcaatggcggcgtggacgaaaaactgaaaatgcaggtcggaccaaaagaagccaagattaccgatgaggtgcttgattttgacgtggtaatggcgcgtctggatcactttatggactggctggcgaaacagtacgtcactgcactgaacatcatccacttcatgcacgataaatacagctatgaagccgcgctgatggcactgcacgatcgtgacgtttaccgcaccatggcatgcggtattgccggactctctgtcgcggccgactcgctgtctgccatcaaatacgcgaaggtgaaaccggtgcgtgatgaagatggcctggccatcgatttcgacatcgaaggagagtatccgcagttcgggaataacgatccccgcgttgacgatctggcctgcgaccttgttgaacgctttatgaaaaagattcagcaactcgaaacctatcgcaacgctgtaccgacccagtctgtgctgaccattacctctaacgtggtttacggcaagaaaaccggtaatacgccagacggtcgccgtgcaggcgcgccttttggtccgggcgctaacccgatgcacggtcgcgatcagaaaggtgccgtggcctcgctgacctcggtggcgaaactgccctttgcttacgcaaaagacggtatctcctacactttctctatcgttcctaatgcgttaggcaaagatgacaacgtgcgtaaaaccaatctggcaggcttgatggacggttacttccatcatgagaccagtattgaaggcggtcagcatcttaatgtgaacgtaatgaaccgggagatgttaatggacgcgatggataatcctgaaaaatatcctcagttaaccattcgcgtctccggctacgccgttcgctttaattcgctgacaaaagagcagcagcaggacgtgatcacccgtacctttacacaatcgctgtaa

SEQ ID NO: 96 - protein, 760 aa, Pantoea ananatis
MTELNAKLASAWQGFTEGEWQNSVNVRDFIQKNYTPYEGNESFLAGATEATTKLWESVLEGIKVENRTHAPVDFDTDLASTITSHDAGYINKSLEKVVGLQTEAPLKRAIIPFGGIKMVEGSCKVYGRELDASLKKIFTDYRKTHNQGVFDVYTPDILRCRKSGILTGLPDAYGRGRIIGDYRRIALYGIDYLMADKFAQFASLQSDLENGVNLEATIRLREEIADQHRALGQIKEMAAKYGHDISGPATNAVEAVQWTYYGYLAAVKSQNGAAMSFGRVSTFLDVFIERDLNAGKLNEAQAQELIDHLVMKLRMVRFLRTPEYDELFSGDPIWATESLAGMGVDGRTLVSKTTFRFLNTLYTMGPSPEPNMTILWSEKLPVNFKKYAAKVSIDTSSLQYENDDLMRPDFDNDDYAIACCVSPMIVGKQMQFFGARANLAKTLLYAINGGVDEKLKMQVGPKEAKITDEVLDFDVVMARLDHFMDWLAKQYVTALNIIHFMHDKYSYEAALMALHDRDVYRTMACGIAGLSVAADSLSAIKYAKVKPVRDEDGLAIDFDIEGEYPQFGNNDPRVDDLACDLVERFMKKIQQLETYRNAVPTQSVLTITSNVVYGKKTGNTPDGRRAGAPFGPGANPMHGRDQKGAVASLTSVAKLPFAYAKDGISYTFSIVPNALGKDDNVRKTNLAGLMDGYFHHETSIEGGQHLNVNVMNREMLMDAMDNPEKYPQLTIRVSGYAVRFNSLTKEQQQDVITRTFTQSL

SEQ ID NO: 97 - DNA, 1614 bp, Pantoea ananatis
  CDS (1)..(1614)
atgtgcaaatcagctgtaaatcttgcgctcatgatgagtgttagcggaaaggacaccaccagggcgcaggagcgtaaagacgttgatgtactgcttattggcgcaggcgtcatgagtgctacgttaggaacctggcttcaggatctggaacctgactggtccatcgaaatggtggagcggctgggacacgtagcggaagagtcttcaaatggctggaacaacgcgggtacaggccatgcggcgctggccgagttgaactatacgcctcagcgagccgatggcagtatcgatatcgccaaagccgttgcgattaacgagtcattccaaatttctcgccagttctgggcttatcacgttcagaaaggcaacctgcatacgccgaaaagctttattcacagcactccgcacatgagctttgtctggggcgatgataatgtcgcgttcctgcgcaagcgctttactgccttacagaaaagcacgctgttccgcggcatggcttactctgaagatccgcaacaaatcgcacagtggattccgctggtcatgaaaggccgtgcgtcgaatcagaaagtggcagcaacctggacagacatgggtaccgacgtcgatttcggtgaagtaacgcgccagctgattgcttcactggagcaaaaagccaacttccgtttacggatgcatcaggaagtgcgcgagattacccgccttaatgatggccgctggcaggtgacgctcgtctgcatgaaagagggtacacgccgcacgttgacggctggaaagatctttattggcgcgggcggtgcggcgctgccgctgctgcagaaggccggcattccggaagccaacggctatgcgggcttcccggttggcggttccttcctggtcaccgagaatccagacgtcgtgaaacagcacatggcgaaagtctatggcaaagccagcgtgggcgcgccaccgatgtccgtgccccatgtcgatacgcgtgtgctgaacggcaagcaggtgctgctgtttggtccctttgcgaccttctcgaccaaattcctgaagcagggctcgctgctggatatgtttgcctcactcaacagcaccaacgtaatgcccatgatcaaggtcggactgaaaagctttgatctggtgaaatacctgatggatcaggtgctgcaaagtgaccgcgatcgtatggatgcactgcgtgcttatgtgccacaggcgaaacaggaagactggcgcctggtgacggccgggcagcgcgtgcaaatcatcaagaaagatgagaaagaaggcgcagtgctgcgtttaggcacggaagtggtgtcgtccgaagacggctctgtctcagcgctgctgggtgcctcgccaggtgcctcgaccgccgcgccgattatgctggagctgctgcataaggtctatccggagcagatggcgtcgccggagtggcaaaataaaatccgtgccgtggtgccgtcctggggccgtaagctgaatggcgatgtggcgctgactgaaaaagtactggcagaaaccagccgtatcctgcagctcaaatacacgccggttacgccagtggctgccaacgatgaaggccgtgaaaccgcctatgtcataggcaaataa

SEQ ID NO: 98 - protein, 537 aa, Pantoea ananatis
MCKSAVNLALMMSVSGKDTTRAQERKDVDVLLIGAGVMSATLGTWLQDLEPDWSIEMVERLGHVAEESSNGWNNAGTGHAALAELNYTPQRADGSIDIAKAVAINESFQISRQFWAYHVQKGNLHTPKSFIHSTPHMSFVWGDDNVAFLRKRFTALQKSTLFRGMAYSEDPQQIAQWIPLVMKGRASNQKVAATWTDMGTDVDFGEVTRQLIASLEQKANFRLRMHQEVREITRLNDGRWQVTLVCMKEGTRRTLTAGKIFIGAGGAALPLLQKAGIPEANGYAGFPVGGSFLVTENPDVVKQHMAKVYGKASVGAPPMSVPHVDTRVLNGKQVLLFGPFATFSTKFLKQGSLLDMFASLNSTNVMPMIKVGLKSFDLVKYLMDQVLQSDRDRMDALRAYVPQAKQEDWRLVTAGQRVQIIKKDEKEGAVLRLGTEVVSSEDGSVSALLGASPGASTAAPIMLELLHKVYPEQMASPEWQNKIRAVVPSWGRKLNGDVALTEKVLAETSRILQLKYTPVTPVAANDEGRETAYVIGK

SEQ ID NO: 99 - DNA, 1173 bp, Methylobacterium extorquens
  CDS (1)..(1173)
atggacgttcacgagtaccaagccaaggagctgctcgcgagcttcggggtcgccgtcccgaagggcgccgtggctttcagcccggatcaagcggtctatgcggcgaccgagctcggcggctcgttctgggcggtgaaggctcagatccatgccggcgcgcgcggcaaggcgggcgggatcaagctttgccgcacctacaatgaagtgcgcgacgccgcccgcgacctgctgggaaaacgcctcgtgacgctccagaccggccccgagggcaagccggtgcagcgcgtctacgtcgagaccgccgacccgttcgagcgtgaactctatctcggctacgtgctcgatcggaaggccgagcgcgtccgtgtcatcgcctcccagcgcggcggcatggatatcgaggagatcgccgccaaggagcccgaggcgctgatccaggtcgtggtcgagccggcggtgggcctgcagcagttccaggcccgcgagatcgcgttccagctcggcctcaacatcaagcaggtctcggccgcggtgaagaccatcatgaacgcctaccgggcgttccgcgactgcgacggcaccatgctggagatcaacccgctcgtcgtcaccaaggacgaccgggttctggcactcgacgccaagatgtccttcgacgacaacgccctgttccgccgccgcaacatcgcggacatgcacgatccatcgcagggcgatccccgcgaggcccaggctgccgagcacaatctcagctatatcggcctcgagggcgaaattggctgcatcgtcaacggcgcgggtctggccatggcgaccatggacatgatcaagcacgcgggcggcgagccggcaaacttcctggatgtgggcggcggtgccagcccggaccgcgtcgccacggccttccgcctcgttctgtcggaccgcaacgtgaaggcgatcctcgtcaacatcttcgccggcatcaaccgctgcgactgggtcgcggagggcgtggtcaaggccgcgcgcgaggtgaagatcgacgtgccgctcatcgtgcggctcgccggcacgaacgtcgatgaaggcaagaagatcctcgccgagagcgggctcgacctcatcaccgccgacacccttacggaagccgcgcgcaaggctgtcgaagcctgccacggcgccaagcactga

SEQ ID NO: 100 - protein, 390 aa, Methylobacterium extorquens
MDVHEYQAKELLASFGVAVPKGAVAFSPDQAVYAATELGGSFWAVKAQIHAGARGKAGGIKLCRTYNEVRDAARDLLGKRLVTLQTGPEGKPVQRVYVETADPFERELYLGYVLDRKAERVRVIASQRGGMDIEEIAAKEPEALIQVVVEPAVGLQQFQAREIAFQLGLNIKQVSAAVKTIMNAYRAFRDCDGTMLEINPLVVTKDDRVLALDAKMSFDDNALFRRRNIADMHDPSQGDPREAQAAEHNLSYIGLEGEIGCIVNGAGLAMATMDMIKHAGGEPANFLDVGGGASPDRVATAFRLVLSDRNVKAILVNIFAGINRCDWVAEGVVKAAREVKIDVPLIVRLAGTNVDEGKKILAESGLDLITADTLTEAARKAVEACHGAKH

SEQ ID NO: 101 - DNA, 891 bp, Methylobacterium extorquens
  CDS (1)..(891)
atgagcattctcatcgacgagaagaccccgatcctggtccagggcatcacgggcgacaagggcaccttccacgccaaggagatgatcgcctacggctcgaacgtcgtcggcggcgtcaccccgggcaagggcggcaagacccattgcggcgtgccggtgttcaacaccgtcaaggaggccgtggaggcgaccggcgccaccacctcgatcaccttcgtggcgccccccttcgcggcggacgcgatcatggaggcggccgacgccggcctcaagctcgtctgctcgatcaccgacggcatccccgctcaggacatgatgcgggtgaaacgctacctccggcgctatccgaaggagaagcgcacgatggtggtgggcccgaactgcgcgggcatcatctcgcccggcaagtcgatgctcggcatcatgcccggccacatctacctcccgggcaaggtcggcgtcatctcccgttccggcacgctgggctacgaggccgccgcgcagatgaaggagctcggcatcggcatctcgacctccgtcggcatcggcggcgatccgatcaacggctcctccttcctcgaccacctcgctctgttcgagcaggatcccgagacggaagccgtgctgatgatcggcgagatcggcgggccgcaggaggccgaggcctcggcctggatcaaggagaacttttccaagcccgtgatcggcttcgtggcgggcctcaccgcccccaagggccgccgcatggggcatgccggcgcgatcatctcggcgaccggcgacagcgccgcggagaaggccgagatcatgcgctcctatggcctgaccgtggcgcccgatccgggctccttcggcagcaccgtggccgacgtgctcgcccgcgcggcgtga

SEQ ID NO: 102 - protein, 296 aa, Methylobacterium extorquens
MSILIDEKTPILVQGITGDKGTFHAKEMIAYGSNVVGGVTPGKGGKTHCGVPVFNTVKEAVEATGATTSITFVAPPFAADAIMEAADAGLKLVCSITDGIPAQDMMRVKRYLRRYPKEKRTMVVGPNCAGIISPGKSMLGIMPGHIYLPGKVGVISRSGTLGYEAAAQMKELGIGISTSVGIGGDPINGSSFLDHLALFEQDPETEAVLMIGEIGGPQEAEASAWIKENFSKPVIGFVAGLTAPKGRRMGHAGAIISATGDSAAEKAEIMRSYGLTVAPDPGSFGSTVADVLARAA

SEQ ID NO: 103 - DNA, 1185 bp, Mesorhizobium loti
  CDS (1)..(1185)
atggacattcacgaatatcaggccaaggaactgctcgcccggcacggcgtgcatgtgccgcgcggcgggctggcctacagccccgaacaggcgacctacagggcgcgcgagatcggcggcggcaaatgggtcttgaaggcgcaggttcattccggcgcgcgcggcaaggccggcggcataaaactgtgcgccaatgacgaggagatctcgagcgccgccgaagccatgctcgggcgcaagctggtgacgcagcagaccggaccgcgcggcaagctgatctcccggctctatctcgaggaagccgtcgatatcgcccaggagctctatgtcggcttcgtgctcgaccgcaaggaagagcgcgtcatgatcgtggcctcggccgccggcggcatggagatcgaggatattgtcgagaaagaacccaattccatcctgcgcacatcggtcgatcccggcgtcggcatgcagcgcttccaggcgcgcgagatcgccttcgggctcggcctcgaccacaacctgatcggcaaggcgaccgaaaccatcttcagctgctaccaggtgttccgcgactacgacgcctcgatgctggagatcaatccgctggtggtgacgcgcgacggcaatctgatcgcgctcgacgccaagatgtctttcgacgagaacgccctgttccgccggcctgaaatctccgagctgcgcgacaagagccaggaagacccgcgcgagactttcgccagcgaccgcggcctctcctatgtcggcctcgacggcaatataggctgcatcatcaatggagcggggctcgccatggcgacaatggacatgatcaagatcgccggcggcgaaccggccaacttcctcgacattggcggcggcgcctcgcccgagcgggtggcgaaatccttccgtgccgtgctcggcgacaagaatgtcgagaccatcctggtcaacatcttcgccggcatcaaccgctgcgactgggtcgccgaaggcgtgatcaaggcgatacgcgaagtcggcgtcaacgtgccgctggtggtgcgtctctccggcaccaaggccgaggaaggccgccgcatactggccgattccggcgaggcggtgatcgtcgccgacacgctggccgaagccgccgaaaaagccgtcgccgcctggcgcgcggccgccaagaaaaaagcagcctga

SEQ ID NO: 104 - protein, 394 aa, Mesorhizobium loti
MDIHEYQAKELLARHGVHVPRGGLAYSPEQATYRAREIGGGKWVLKAQVHSGARGKAGGIKLCANDEEISSAAEAMLGRKLVTQQTGPRGKLISRLYLEEAVDIAQELYVGFVLDRKEERVMIVASAAGGMEIEDIVEKEPNSILRTSVDPGVGMQRFQAREIAFGLGLDHNLIGKATETIFSCYQVFRDYDASMLEINPLVVTRDGNLIALDAKMSFDENALFRRPEISELRDKSQEDPRETFASDRGLSYVGLDGNIGCIINGAGLAMATMDMIKIAGGEPANFLDIGGGASPERVAKSFRAVLGDKNVETILVNIFAGINRCDWVAEGVIKAIREVGVNVPLVVRLSGTKAEEGRRILADSGEAVIVADTLAEAAEKAVAAWRAAAKKKAA

SEQ ID NO: 105 - DNA, 900 bp, Mesorhizobium loti
  CDS (1)..(900)
atggcaatcctgctcaaccgcagcacccgcgtcatcgtccagggtttcaccggcaagatcggcagcttccacgccgaggacatgaaacgctatggcaccaagctggtcggcggcgtcacccccggcaagggcggccagacgcatctcggcctgcccgtcttcaacacggtcaagggcgccgtgcgcgagacccgcgccgaggcgagcatcgtcttcgtgccgccacccttcgccgccgattcgatcatggaagccgcggacgccggcatcaaactctgcgtctgcatcaccgacggcatcccctcgcaggacatgatgcaggtcaagcgctacatgcgccgctatcgtttcgaggaccgcatgaggctgatcggcccgaactgcgccggcatgatcacgccgggacaggcactgatgggcatcatgccgggcagcatctatctgcccggccgcgtcggcattgtcggccgctccggcacactcggctacgaggccgcctcgcagatgaaggcgcttggcatcggcgtgtcgaccagcgtcggcatcggcggcgacccgatcaacggctcctccttcaaggacatcctgaagctgttcgagcaggacgacgagaccgacgccgtggtgatgatcggcgagatcggcggcccgcaagaggcggaagccgcgatctgggcgcgcgacaacatgcgcaagccgcttatcgcctacattgccggcctctccgccccgaaaggccgccgcatgggccacgccggcgccatcatctccgccttcggcgagtcggcgcaggagaaggtcgagatcctgaaggaggccggcgtgatcatcgtgccgacaccgtcatcgtttggcgaggtggtggcggatacgctggcacggatgaagaaggcggcgtga

SEQ ID NO: 106 - protein, 299 aa, Mesorhizobium loti
MAILLNRSTRVIVQGFTGKIGSFHAEDMKRYGTKLVGGVTPGKGGQTHLGLPVFNTVKGAVRETRAEASIVFVPPPFAADSIMEAADAGIKLCVCITDGIPSQDMMQVKRYMRRYRFEDRMRLIGPNCAGMITPGQALMGIMPGSIYLPGRVGIVGRSGTLGYEAASQMKALGIGVSTSVGIGGDPINGSSFKDILKLFEQDDETDAVVMIGEIGGPQEAEAAIWARDNMRKPLIAYIAGLSAPKGRRMGHAGAIISAFGESAQEKVEILKEAGVIIVPTPSSFGEVVADTLARMKKAA

SEQ ID NO: 107 - DNA, 1170 bp, Granulibacter bethesdensis
  CDS (1)..(1170)
atggacgtccatgagtaccaggcaaaagaattgcttgcgagcgccggtgtggccgtgccccgcggtgcaatcgctttcagcgctgatcaggccgtgtatgccgcgaccgaactgggtggctggcactgggcggtgaaagcccagattcatgccggtgcgcgcggcaaggccggcggcatcaagctgtgcaagacgtatcatgaagtgcgcgaggctgctgccggtatgctcggcaagcgtctggtcacgcatcagaccggtccggaaggcaagcctgtccagcgcgtgtatgtcgaggtcgccgatcccttcgagaaagaattctatctgggctttgtgctggatcgtaagctggagcgcgtgcgtgtgatcgcctccgccgagggcggcatggagatcgaggaaatcgcttccaagcatccggaaaagctgatccaggtgatcgtggagccggcggttggtcttcagcagttccaggcccgccagatcgccttcaagctgggcctgtccagccgtcaggtacagcgtgcggtgaccagcatcatgggcgcttatcgcgcattccgcgatcacgacgcgaccatgctggaaatcaatcctctggttctgaccaaggatgaccgtattctggcgctcgatgcgaagatgagcttcgacgacaacgccttgttccgtcgcaacaacgtcgccaacatgcatgacccctctcaggacgatccgcgtgaggcgcaggctgccgagcacaacctcaactatgtgggtctggaaggcgatatcggctgcgtggtgaatggcgccggcctggcgatggcgaccatggacgtcatcaaatatgcgggtggtgagcctgccaacttcctcgatgtcggcggcggggcaagccccgagcgtaccgcgacggcgttccgtctggtgctgtccgacaagaacgtgaaggttgttctggtcaacatcttcgccggcatcaaccgctgcgactggatcgcggaaggcgtggtgcacgcggtgaaagaagtcgatctgaagcttccgctggtggtgcgtctggcaggcaccaatgtggaggaaggccgccgtattctgaaagaaagcggcatttccgtcatcatggccgaaagcctgaccgaagcggccgaaaaggccgtcgaggccgcgaaggccgcggcgtaa

SEQ ID NO: 108 - protein, 389 aa, Granulibacter bethesdensis
MDVHEYQAKELLASAGVAVPRGAIAFSADQAVYAATELGGWHWAVKAQIHAGARGKAGGIKLCKTYHEVREAAAGMLGKRLVTHQTGPEGKPVQRVYVEVADPFEKEFYLGFVLDRKLERVRVIASAEGGMEIEEIASKHPEKLIQVIVEPAVGLQQFQARQIAFKLGLSSRQVQRAVTSIMGAYRAFRDHDATMLEINPLVLTKDDRILALDAKMSFDDNALFRRNNVANMHDPSQDDPREAQAAEHNLNYVGLEGDIGCVVNGAGLAMATMDVIKYAGGEPANFLDVGGGASPERTATAFRLVLSDKNVKVVLVNIFAGINRCDWIAEGVVHAVKEVDLKLPLVVRLAGTNVEEGRRILKESGISVIMAESLTEAAEKAVEAAKAAA

SEQ ID NO: 109 - DNA, 897 bp, Granulibacter bethesdensis
  CDS (1)..(897)
atgagcattctgatcaataagcagaccaagatcatcattcagggcttcaccggcgacaagggcacgttccacggtcgcgagatgatcgattacggcaccaatgtcgtcggtggcgtgacgcccggtaaaggcggccagacccatctgggtcgtcccgtgttcaacacggtcgaggacgcggtgcgtgaaaccggtgcccaggcgtcgatcacctttgtggcacctgccttttgcgccgatgcgatcatggaaggcgccgatgcggggctggagctgatctgcaccatcacggacggtattccggcgcaggatatgatgcgcgtgaagcgttatctgcgccgctaccagaaggatcgtcgcacgcgtctggtggggccgaactgcgcgggcatcatcagcccgggccaggccatgctgggcatcatgccgggccatatctacaaggaaggccatgtcggcattgtttcccgctcaggcacgctcggctatgaagccgccgcgcagctgaaggagctgggcatcggtgtgtccaccagtgtgggtatcggtggtgacccgatcaatggttcttccttccttgatcaccttcagctgttcgaagccgaccccgagactcatgccgtgctgatgatcggcgagatcggtggcccgcaggaagccgaagcggcgaagtggatcagcgagaacatgtcgaagccggtggttggctacgttgccggcctgaccgctccgaaggggcgtcgtatgggccatgccggtgcgatcatctctggcgaaggcgacagcgccgccgaaaagagcgagatcatgcgctcctacggtctgacggttgctcccagcccgggtgaactcggctcgaccgttgccgcggtgctggctgggcgtcaggcagcctga

SEQ ID NO: 110 - protein, 298 aa, Granulibacter bethesdensis
MSILINKQTKIIIQGFTGDKGTFHGREMIDYGTNVVGGVTPGKGGQTHLGRPVFNTVEDAVRETGAQASITFVAPAFCADAIMEGADAGLELICTITDGIPAQDMMRVKRYLRRYQKDRRTRLVGPNCAGIISPGQAMLGIMPGHIYKEGHVGIVSRSGTLGYEAAAQLKELGIGVSTSVGIGGDPINGSSFLDHLQLFEADPETHAVLMIGEIGGPQEAEAAKWISENMSKPVVGYVAGLTAPKGRRMGHAGAIISGEGDSAAEKSEIMRSYGLTVAPSPGELGSTVAAVLAGRQAA

SEQ ID NO: 111 - DNA, 1167 bp, Escherichia coli
  CDS (1)..(1167)
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataa

SEQ ID NO: 112 - protein, 388 aa, Escherichia coli
MNLHEYQAKQLFARYGLPAPVGYACTTPREAEEAASKIGAGPWVVKCQVHAGGRGKAGGVKVVNSKEDIRAFAENWLGKRLVTYQTDANGQPVNQILVEAATDIAKELYLGAVVDRSSRRVVFMASTEGGVEIEKVAEETPHLIHKVALDPLTGPMPYQGRELAFKLGLEGKLVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDKVKAVLVNIFGGIVRCDLIADGIIGAVAEVGVNVPVVVRLEGNNAELGAKKLADSGLNIIAAKGLTDAAQQVVAAVEGK

SEQ ID NO: 113 - DNA, 870 bp, Escherichia coli
  CDS (1)..(870)
atgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataa

SEQ ID NO: 114 - protein, 289 aa, Escherichia coli
MSILIDKNTKVICQGFTGSQGTFHSEQAIAYGTKMVGGVTPGKGGTTHLGLPVFNTVREAVAATGATASVIYVPAPFCKDSILEAIDAGIKLIITITEGIPTLDMLTVKVKLDEAGVRMIGPNCPGVITPGECKIGIQPGHIHKPGKVGIVSRSGTLTYEAVKQTTDYGFGQSTCVGIGGDPIPGSNFIDILEMFEKDPQTEAIVMIGEIGGSAEEEAAAYIKEHVTKPVVGYIAGVTAPKGKRMGHAGAIIAGGKGTADEKFAALEAAGVKTVRSLADIGEALKTVLK

SEQ ID NO: 115 - DNA, 1167 bp, Pantoea ananatis
  CDS (1)..(1167)
atgaacttacacgaataccaggctaaacagctgtttgcacggtatggcatgccagcaccgaccggctacgcctgtactacaccacgtgaagcagaagaagcggcatcgaaaatcggtgcaggcccgtgggtagttaaatgtcaggttcatgccggtggccgcggtaaagcgggcggtgtgaaagtggttaacagcaaagaagacatccgtgctttcgctgaaaactggctgggcaaacgtctggtgacctaccaaactgacgccaatggtcagccggtaaaccagattctggttgaagcggcaaccgatatcgatcaggagctgtacctgggtgccgtggttgaccgtgcaacccgtcgcgtcatctttatggcatcgactgaaggcggcgtggaaatcgagaaagtggcagaagaaacgccacacctgatccacaaaatggcgcttgatccactggccggtccacagccttatcagggccgtgagttagcctttaaactgggcctgaccggtaagcaagtcagccagttcaccaaaattttcatgggtctggccaccatgttcctggagcgcgatctggcgatggttgagatcaacccgctggtgatcaccaagcagggcgacctgatctgtctggatggcaaactgggtgctgatggcaatgccctgttccgtcagccagagctgcgtgaaatgcgcgatccaagccaggaagatcctcgtgaagcgcacgcgacacagtgggaactgaactatgttgcgctggaaggcaacatcggttgtatggttaacggcgcaggcctcgcgatgggtacgatggacatcgttaagcaccacggtggccagccagcgaacttcctggatgttggcggcggcgcgaccaaagagcgcgtaaccgaagcctttaaaatcatcctgtctgacgacgcggtgaaagcggtattcgttaacatcttcggcggcatcgtgcgttgcgacctgatcgcagacggcatcatcggtgcagtagcagaagtcggtgttaacgtaccggtcgtggtacgtctggaaggtaacaacgctgaactgggcgctaagaaactggcggacagtggtctgaacatcattgcagcaaccagtctgacagacgcggcacagcgtgttgttgctgctgcggagggtaaataa

SEQ ID NO: 116 - protein, 388 aa, Pantoea ananatis
MNLHEYQAKQLFARYGMPAPTGYACTTPREAEEAASKIGAGPWVVKCQVHAGGRGKAGGVKVVNSKEDIRAFAENWLGKRLVTYQTDANGQPVNQILVEAATDIDQELYLGAVVDRATRRVIFMASTEGGVEIEKVAEETPHLIHKMALDPLAGPQPYQGRELAFKLGLTGKQVSQFTKIFMGLATMFLERDLAMVEINPLVITKQGDLICLDGKLGADGNALFRQPELREMRDPSQEDPREAHATQWELNYVALEGNIGCMVNGAGLAMGTMDIVKHHGGQPANFLDVGGGATKERVTEAFKIILSDDAVKAVFVNIFGGIVRCDLIADGIIGAVAEVGVNVPVVVRLEGNNAELGAKKLADSGLNIIAATSLTDAAQRVVAAAEGK

SEQ ID NO: 117 - DNA, 876 bp, Pantoea ananatis
  CDS (1)..(876)
atgtccattttgatcgacaaaaacaccaaagtcatttgccagggattcaccggcggacagggaactttccactctgagcaggcgctggcatacggcacgcagctggttggcggcgtaaccccgggcaaaggcggcacgacccatctgggcctgccggtgttcaacaccgtgcgtgaagccgttgaagccacaggcgcgaccgcaaccgttatctatgtgccagctccgttctgcaaagacggtatcctggaagctatcgatgccggtatcaagctgatcatcaccatcaccgaaggcattccaacgctggatatgctgaccgtgaagatgaagctggatgaagcaggcgtgcgcatgatcgggccaaactgcccgggtgtgatcactcctggcgaatgtaagatcggcatcatgccgggccacattcaccagcctggccgtgtcggtatcgtttcgcgttccggtaccctgacctatgaagccgttaagcaaaccaccgatatcggttacggtcagtctacctgtgtcggcatcggcggtgacccgatcccgggctctaacttcatcgacatcctgaaaatgttccaggacgatccacagactgaagcgatcgtcatgatcggtgaaatcggtggtagtgcggaagaagaagctgctgcgttcatcaaagagcacgtgaccaagccggttgtcggctacattgcgggcgtaacggcaccgaagggcaaacgtatgggccacgctggtgccatcattgccggtggtaaaggaacggcagacgagaagtttgctgcgctggaagccgcaggtgtgaaaaccgtacgcagcctggctgacatcggcgatgccgtgaaagcggttctgccagccaaataa

SEQ ID NO: 118 - protein, 291 aa, Pantoea ananatis
MSILIDKNTKVICQGFTGGQGTFHSEQALAYGTQLVGGVTPGKGGTTHLGLPVFNTVREAVEATGATATVIYVPAPFCKDGILEAIDAGIKLIITITEGIPTLDMLTVKMKLDEAGVRMIGPNCPGVITPGECKIGIMPGHIHQPGRVGIVSRSGTLTYEAVKQTTDIGYGQSTCVGIGGDPIPGSNFIDILKMFQDDPQTEAIVMIGEIGGSAEEEAAAFIKEHVTKPVVGYIAGVTAPKGKRMGHAGAIIAGGKGTADEKFAALEAAGVKTVRSLADIGDAVKAVLPAK

SEQ ID NO: 119 - DNA, 1197 bp, Corynebacterium glutamicum
  CDS (1)..(1197)
gtggatctttttgaataccaagcacgggacctctttgaaacccatggtgtgccagtgttgaagggaattgtggcatcaacaccagaggcggcgaggaaagcggctgaggaaatcggcggactgaccgtcgtcaaggctcaggtcaaggtgggcggacgtggcaaggcgggtggcgtccgtgtggcaccgacgtcggctcaggcttttgatgctgcggatgcgattctcggcatggatatcaaaggacacactgttaatcaggtgatggtggcgcagggcgctgacattgctgaggaatactatttctccattttgttggatcgcgcgaatcgttcgtatctggctatgtgctctgttgaaggtggcatggagatcgagatcctggcgaaggaaaagcctgaagctttggcaaaggtggaagtggatcccctcactggtattgatgaggacaaagcgcgggagattgtcactgctgctggctttgaaactgaggtggcagagaaagtcattccggtgctgatcaagatctggcaggtgtattacgaagaggaagcaacactcgttgaggtgaacccgttggtgctcacggatgacggcgatgtgattgcgcttgatggcaagatcacgctggatgataacgctgatttccgccatgataaccgtggtgcgttggctgaatctgccggtggcttggacattttggaactgaaggccaagaagaatgatctgaactacgtgaaacttgatggctctgtgggcatcattggcaatggtgcaggtttggtgatgtccacgttggatatcgtggctgcagctggtgaacgccatggtgggcagcgccccgcgaacttcctagacattggtggcggagcatcagctgaatcgatggctgctggtctcgatgtgatccttggggatagccaggtacgcagtgtgtttgtgaatgtgtttggtggcatcaccgcgtgtgatgtggtggcaaagggaatcgttggagctttggatgtgctcggcgatcaagcaacgaagcctcttgtggtgcgccttgatggcaacaacgtggtggaaggcagacgaatcctcgcggaatataaccaccctttggtcaccgttgtggagggtatggatgcagcggctgatcacgctgcccatttggccaatcttgcccagcacggccagttcgcaaccgctaattag

SEQ ID NO: 120 - protein, 398 aa, Corynebacterium glutamicum
MDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 121 - DNA, 885 bp, Corynebacterium glutamicum
  CDS (1)..(885)
atgtctatttttctcaattcagattcccgcatcatcattcagggcattaccggttcggaaggttcagagcatgcgcgtcgaattttagcctctggtgcgaagctcgtgggtggcaccaacccccgcaaagctgggcaaaccattttgatcaatgacactgagttgcctgtatttggcactgttaaggaagcaatggaggaaacgggtgcggatgtcaccgtaattttcgttcctccagcctttgccaaagctgcgatcattgaagctatcgacgctcacatcccactgtgcgtgattattactgagggcatcccagtgcgtgacgcttctgaggcgtgggcttatgccaagaaggtgggacacacccgcatcattggccctaactgcccaggcattattactcccggcgaatctcttgcgggaattacgccggcaaacattgcaggttccggcccgatcgggttgatctcaaagtcgggaacactgacttatcagatgatgtacgaactttcagatattggcatttctacggcgattggtattggcggtgacccaatcatcggtacaacccatatcgacgctctggaggcctttgaagctgatcctgagaccaaggcaatcgtcatgatcggtgagatcggtggagatgcagaggaacgcgctgctgacttcatttctaagcacgtgacaaaaccagttgtgggttacgtggcaggctttaccgcccctgaaggaaagaccatggggcatgctggcgccatcgtgacaggttcagaaggcactgcgcgagcaaagaagcatgcattggaggccgtgggtgttcgcgtgggaacaactccgagtgaaaccgcgaagcttatgcgtgaggtagttgcagctttgtaa

SEQ ID NO: 122 - protein, 294 aa, Corynebacterium glutamicum
MSIFLNSDSRIIIQGITGSEGSEHARRILASGAKLVGGTNPRKAGQTILINDTELPVFGTVKEAMEETGADVTVIFVPPAFAKAAIIEAIDAHIPLCVIITEGIPVRDASEAWAYAKKVGHTRIIGPNCPGIITPGESLAGITPANIAGSGPIGLISKSGTLTYQMMYELSDIGISTAIGIGGDPIIGTTHIDALEAFEADPETKAIVMIGEIGGDAEERAADFISKHVTKPVVGYVAGFTAPEGKTMGHAGAIVTGSEGTARAKKHALEAVGVRVGTTPSETAKLMREVVAAL

SEQ ID NO: 123 - DNA, 1275 bp, Corynebacterium glutamicum
  CDS (1)..(1275)
ttggaacacttacttttacgggaagactttgttaaagacgcagaaggctctaagcatgggccggaaatggaattggcagtggatctttttgaataccaagcacgggacctctttgaaacccatggtgtgccagtgttgaagggaattgtggcatcaacaccagaggcggcgaggaaagcggctgaggaaatcggcggactgaccgtcgtcaaggctcaggtcaaggtgggaggacgtggcaaggcgggtggcgtccgtgtggcaccgacgtcggctcaggcttttgatgctgcggatgcgattctcggcatggatatcaaaggacacactgttgatcaggtgatggtggcgcagggcgctgacattgctgaggaatactatttctccattttgttggatcgcgcgaatcgttcgtatctggctatgtgctctgttgaaggtggcatggagatcgagatcctggcgaaggaaaagcctgaagctttggcaaaggtggaagtggatcccctcactggtattgatgaggacaaagcgcgggagattgtcactgctgctggctttgaagctgaggtggcagagaaagtcattccggtgctgatcaagatctggcaggtgtattacgaagaggaagcaacactcgttgaggtgaacccgttggtgctcacggatggcggcgatgtgattgcgcttgatggcaagatcacgctggatgataacgctgatttccgccatgataaccgtggtgcgttggctgaatctgccggtggcttggacattttggaactgaaggccaagaagaatgatctgaactacgtgaaacttgatggctctgtgggcatcattggcaatggtgcaggtttggtgatgtccacgttggatatcgtggctgcagctggtgaacgccatggtgggcagcgccccgcgaacttcctagacattggtggcggagcatcagctgaatcgatggctgctggtctcgatgtgatccttggcgatagtcatgtgcgcagtgtgtttgtgaatgtgtttggtggcatcaccgcgtgtgatgtggtggcaaagggaatcgttggagctttggatgtgctcggcgatcaagcaacgaagcctcttgtggtgcgccttgatggcaacaacgtggtggaaggcagacgaatcctcgcggaatataaccaccccttggtcaccgttgtggagggtatggatgcagcggctgatcacgctgcccatttggccaatcttgcccagcacggccagttcgcaaccgctaattag

SEQ ID NO: 124 - protein, 424 aa, Corynebacterium glutamicum
MEHLLLREDFVKDAEGSKHGPEMELAVDLFEYQARDLFETHGVPVLKGIVASTPEAARKAAEEIGGLTVVKAQVKVGGRGKAGGVRVAPTSAQAFDAADAILGMDIKGHTVDQVMVAQGADIAEEYYFSILLDRANRSYLAMCSVEGGMEIEILAKEKPEALAKVEVDPLTGIDEDKAREIVTAAGFEAEVAEKVIPVLIKIWQVYYEEEATLVEVNPLVLTDGGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSHVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 125 - DNA, 885 bp, Corynebacterium glutamicum
  CDS (1)..(885)
atgtctatttttctcaattcagattcccgcatcatcattcagggcattaccggttcggaaggttcagagcatgcgcgtcgaattttagcctctggtgcgaagctcgtgggtggcaccaacccccgcaaagctgggcaaaccattttgatcaatgacactgagttgcctgtatttggcactgttaaggaagcaatggaggaaacgggtgcggatgtcaccgtaattttcgttcctccagcctttgccaaagctgcgatcattgaagctatcgacgctcacatcccactgtgcgtgattattactgagggcatcccagtgcgtgacgcttctgaggcgtgggcttatgccaagaaggtgggacacacccgcatcattggccctaactgcccaggcattattactcccggcgaatctcttgcgggaattacgccggcaaacattgcaggttccggcccgatcgggttgatctcaaagtcgggaacactgacttatcagatgatgtacgaactttcagatattggcatttctacggcgattggtgttggcggtgacccaatcatcggtacaacccatatcgacgctctggaggcctttgaagctgatcctgagaccaaggcaatcgtcatgatcggtgagatcggtggagatgcagaggaacgcgctgctgacttcatttctaagcacgtgacaaaaccagttgtgggttacgtggcaggctttaccgcccctgaaggaaagaccatggggcatgctggcgccatcgtgacaggttcagaaggcactgcgcgagcaaagaagcatgcattggaggccgtgggtgttcgcgtgggaacaactccgagtgaaaccgcgaagcttatgcgtgaggtagttgcagctttgtaa

SEQ ID NO: 126 - protein, 294 aa, Corynebacterium glutamicum
MSIFLNSDSRIIIQGITGSEGSEHARRILASGAKLVGGTNPRKAGQTILINDTELPVFGTVKEAMEETGADVTVIFVPPAFAKAAIIEAIDAHIPLCVIITEGIPVRDASEAWAYAKKVGHTRIIGPNCPGIITPGESLAGITPANIAGSGPIGLISKSGTLTYQMMYELSDIGISTAIGVGGDPIIGTTHIDALEAFEADPETKAIVMIGEIGGDAEERAADFISKHVTKPVVGYVAGFTAPEGKTMGHAGAIVTGSEGTARAKKHALEAVGVRVGTTPSETAKLMREVVAAL

SEQ ID NO: 127 - DNA, 1368 bp, Chloroflexus aurantiacus
  CDS (1)..(1368)
atggcaaaagcgtcacgcctgaccagatcaaccggtcagccaacggaggtgtcagaaggacaggtcaccgggacaagcgagatgccccccacaggagaagaaccatcaggacacgcagaatcaaagccgccggccagtgatccgatgagcacaccgggcaccggtcaggagcagttgccgttgagtggcattcgggtcattgatgtaggtaattttctggccggcccgtatgctgcttccatcctgggtgaattcggtgccgaggtgctcaagatcgaacacccgctgggtggcgatccgatgcgtcgtttcggcactgcaactgcgcgccacgatgcaacactggcctggctgagcgaggcccgtaaccgtaagtcggtcacgattgatctgcgtcagcaagagggcgttgcgctctttctgaagctggtcgccaaatccgacattctgattgaaaactttcgccccggtacgatggaagaatggggcttgagctggcctgttttgcaggcgacgaatcccggactgattatgctgcgggtgtcgggctatggtcagaccgggccgtaccgtcggcgttcggggtttgcccatattgcccacgctttcagcggcctctcgtatctggccgggttccccggcgaaacgccagtcttgccgggaacggcaccgctcggcgactatatcgccagtctgttcggggcgattgggattttgatcgcgctgcgccacaaagagcagaccggacgcgggcagttgatcgatgtcgggatttacgaagcggtcttccggattctggatgagattgccccggcttacggtctgttcggcaagattcgtgaacgcgaaggggccgggagttttattgctgttccgcatggccatttccgctcgaaggacggcaagtgggttgcgattgcctgtaccaccgacaagatgtttgaacggctggccgaagcaatggagcgcccggaactggcttcgccggaactgtacggcgatcaacgcaaacggctggcagcacgcgatattgtgaaccagatcacgattgaatgggtcggttcgttgacgcgcgacgaggtgatgcggcgttgtctggagaaggaagttcccgttggcccactcaacagcatcgccgatatgttcaacgacgaacattttctggctcgcggcaactttgcctgtatcgaagccgagggtatcggcgaagtggtggttccgaacgtgatccccagactgtcagaaacaccgggacgggtgaccaacctcggcccaccgctggggaatgccacgtatgaggtgttgcgcgagctgcttgatatttctgccgaagagatcaagcgtctgcgcagccgcaagattatttag

SEQ ID NO: 128 - protein, 455 aa, Chloroflexus aurantiacus
MAKASRLTRSTGQPTEVSEGQVTGTSEMPPTGEEPSGHAESKPPASDPMSTPGTGQEQLPLSGIRVIDVGNFLAGPYAASILGEFGAEVLKIEHPLGGDPMRRFGTATARHDATLAWLSEARNRKSVTIDLRQQEGVALFLKLVAKSDILIENFRPGTMEEWGLSWPVLQATNPGLIMLRVSGYGQTGPYRRRSGFAHIAHAFSGLSYLAGFPGETPVLPGTAPLGDYIASLFGAIGILIALRHKEQTGRGQLIDVGIYEAVFRILDEIAPAYGLFGKIREREGAGSFIAVPHGHFRSKDGKWVAIACTTDKMFERLAEAMERPELASPELYGDQRKRLAARDIVNQITIEWVGSLTRDEVMRRCLEKEVPVGPLNSIADMFNDEHFLARGNFACIEAEGIGEVVVPNVIPRLSETPGRVTNLGPPLGNATYEVLRELLDISAEEIKRLRSRKII

SEQ ID NO: 129 - DNA, 1218 bp, Chloroflexus aurantiacus
  CDS (1)..(1218)
atggatggaacgaccacaacgttgccgctggccggaattcgcgttatcgatgccgcgacggtgattgctgcgcctttttgtgcgaccctgttgggcgaattcggcgctgacgtgttgaaagtagaacatcctatcggcggtgatgcgctgcgccgcttcgggacgccgaccgcacgcggcgatacgctgacctggctgagcgagtcgcgcaacaagcgttcggttacgctcaacctgcaacatcccgaaggggcgcgtgtcttcaaagagctgatcgcccactccgatgtgctgtgcgaaaattttcgccccggtacgctggaaaaatgggggctgggttgggatgtgttgagcaagatcaacccgcgcctgattatgttgcgggtcaccggctatgggcagaccgggccgtaccgtgatcgaccggggtttgcccggattgcgcacgccgtcggtggcatcgcgtatctggccggtatgccgaaagggacaccggtgacgccggggtcaacgacactcgccgattacatgaccggtctctacggctgtattggcgtgctgctggcgctgcgccaccgcgaacagaccggacgcggccagtacattgatgccgctctgtacgaatcggtcttccgctgtagcgatgagctggtgccggcctacgggatgtatcgcaaggtgcgtgaacgccacggttcccactacaacgagtttgcctgtcctcacggccacttccagaccaaagacgggaaatgggtggcgatctcgtgtgcgaccgataagctgtttgcccgactggcaaatgcgatggggcgccccgaactggcgtcgtcgagtgtctacggcgaccagaaagtacggctggcgcacgccagtgatgtgaacgagattgtgcgtgactggtgtagctcgctgacccgcgccgaagtgcttgagcgctgttacgccacggctaccccggcggcaccgctgaacgacattgccgacttcttcggtgatcgccacgtccacgctcgtcggaatctggtcgcgattgatgccgaagacctgggggagacgttgatcatgccgaatgtggtgccaaagctctcggagacaccgggcagcattcgctcgctcggcccgaaactcggcgagcatacggaagaggtcttgaaagagattctcggcatgtgcgacgagcagatcaacgatctgcgttcaaagcgggtgatatag

SEQ ID NO: 130 - protein, 405 aa, Chloroflexus aurantiacus
MDGTTTTLPLAGIRVIDAATVIAAPFCATLLGEFGADVLKVEHPIGGDALRRFGTPTARGDTLTWLSESRNKRSVTLNLQHPEGARVFKELIAHSDVLCENFRPGTLEKWGLGWDVLSKINPRLIMLRVTGYGQTGPYRDRPGFARIAHAVGGIAYLAGMPKGTPVTPGSTTLADYMTGLYGCIGVLLALRHREQTGRGQYIDAALYESVFRCSDELVPAYGMYRKVRERHGSHYNEFACPHGHFQTKDGKWVAISCATDKLFARLANAMGRPELASSSVYGDQKVRLAHASDVNEIVRDWCSSLTRAEVLERCYATATPAAPLNDIADFFGDRHVHARRNLVAIDAEDLGETLIMPNVVPKLSETPGSIRSLGPKLGEHTEEVLKEILGMCDEQINDLRSKRVI

SEQ ID NO: 131 - DNA, 1248 bp, Accumulibacter phosphatis
  CDS (1)..(1248)
ttgtcgcagaatcctctggagcaggatcaggagcagtcagcggacaacgaccaactaccgatgagcggcttgcgcgtcatcgatgtcgggacttttctggccgggccctatgcggcatccatcctgggtgagttcggcgccgagattctgaaagtcgagcatccgatcgccggtgatccgatgcggcacttcggaacggcctccaaacgccacgatgcgaccctggcctggctcagcgaaggccgcaacaagaaatcggtcaccctcgacctccgccagcaggagggtgtcgagctgttcctcaagctggtggccaagtcggacgtgctgatcgagaatttccggccgggaacgatggaggaatggggactcggctgggacgagttgagcaaggccaaccccgcactcgtgatgctacgggtctccggctacgggcagaccggaccgtatcgtcgacgctcgggtttcgcgcatatcgcccatggctttgccggtctgtcctacctcgccggctttccgggcgagacgccagtactgccgggaacggcgccgcttggcgactacctgtccagcctttatggcgctatcggcatcctgctggcattaaggcaccgcgaggcgaccggcgaagggcaaatcgtcgatatcggaatttacgaggcggttttccgccagatggacgagatcgccgccgcttacggactgttcggcaaggtccggcaacgcgaaggtgccggcagtttcgtcgccgttccgcacggacacttccggactgttgatgacaaatgggtcgccatcgcgtgcaccacggacaagatgttcgaacgtttcgccgcggcgatggagaagcccgagctcgctgcggccgaccgttacggcgaccaacgcaagcgtctggcagcgcgtgacgaggtcaaccggatcgtcatcgaatgggtgggttcgctgacccgcaacgaggtgatgcagcgctgtattgatggtgaggtaccgatcggcaagctcaacagcatcgccgacatgttcgaggatgagcatttcaaagcccgcggcaatctcgcccgcctcaccgaggagggcctgggggaagtggtgattccgggcgtcgtgccgacgctttccgagaccccggggcggatttcgaatctcgggccaccgctgggcaacgccacctatgaagtcctgcgcgaactactcggtatttcggcgcaggagatcaagcgactgcgccagcgcaagatcatctga

SEQ ID NO: 132 - protein, 415 aa, Accumulibacter phosphatis
MSQNPLEQDQEQSADNDQLPMSGLRVIDVGTFLAGPYAASILGEFGAEILKVEHPIAGDPMRHFGTASKRHDATLAWLSEGRNKKSVTLDLRQQEGVELFLKLVAKSDVLIENFRPGTMEEWGLGWDELSKANPALVMLRVSGYGQTGPYRRRSGFAHIAHGFAGLSYLAGFPGETPVLPGTAPLGDYLSSLYGAIGILLALRHREATGEGQIVDIGIYEAVFRQMDEIAAAYGLFGKVRQREGAGSFVAVPHGHFRTVDDKWVAIACTTDKMFERFAAAMEKPELAAADRYGDQRKRLAARDEVNRIVIEWVGSLTRNEVMQRCIDGEVPIGKLNSIADMFEDEHFKARGNLARLTEEGLGEVVIPGVVPTLSETPGRISNLGPPLGNATYEVLRELLGISAQEIKRLRQRKII

SEQ ID NO: 133 - DNA, 1227 bp, Accumulibacter phosphatis
  CDS (1)..(1227)
atgaccactgatcagaccgagacccggttgccgctcgaaggcattcgcgtcatcgatgccgccacggtcatcgccgcaccttacagtgccagcatcctcggcgagttcggcgccgatgtcctgaaggtcgagaacccgaaaggcggcgatcccctgcgctacttcggtacgccgaccaaccgcaaggacacgctggcctggctcagcgaagcccgcaacaagcgatcggtgacgctcgacctgcacttgccggaaggcgtcgagttgttcaaggggctgatcgagaaatcggatgtgctgtgcgagaacttccggccgggcaccctcgagaagtggggactcggctgggaggtgctgcgcgagatcaaccctggcctgatcatgttgcgcgttaccggttatgggcagaccggcccctacaaggaccgtcccggctttgcccgcgtcgcacacgccgttggcggcatcgcctttctctcgggaatgccgagaggaacgccggtgaccccgggctcgaccaccctcggcgattacctgaccggcctctatggctgtatcggcatcctgatggccctgcgccaccgcgagcgcaccggcaagggacagtacatcgacgctgcgctgtacgagtcggtgtttcgctgcaccgaagaactggcgccggcctatggcatgttcggtcgcgtgcgcgagaggcacgggccaacgcacaacgatttcgcttgcccacacggccacttcccgaccaaggaagatggcaaatgggtagccatttcgtgcgtcaccgacaagctcttcgagcgcctggcaattgccatgggccgcccggaactggcagcgccgcatgtctacggcgaccagaagacacggcttgacaaccggcatgacgtgaacgaaatcgtcagggactggtgcggttcgctgcaccgggaggaaatccttgcccgctgcttcgccgccggtgccccggccggaccattgaacagcatcgccgacattttcggcgaccggcaatttcattcgcggcgcaacctggtcgcgatcgatgagccggacatcggcgagacggtgatcgttccatcggtgttgccacgcctgtcggcgacaccgggaaggatcaagcacctcgggccgcgactcgggcagcataccgacgaagtactgtccggcttgctcggcctggacgagcacgagatcgacgcgctgcgcaagaagcgtgtaatctga

SEQ ID NO: 134 - protein, 408 aa, Accumulibacter phosphatis
MTTDQTETRLPLEGIRVIDAATVIAAPYSASILGEFGADVLKVENPKGGDPLRYFGTPTNRKDTLAWLSEARNKRSVTLDLHLPEGVELFKGLIEKSDVLCENFRPGTLEKWGLGWEVLREINPGLIMLRVTGYGQTGPYKDRPGFARVAHAVGGIAFLSGMPRGTPVTPGSTTLGDYLTGLYGCIGILMALRHRERTGKGQYIDAALYESVFRCTEELAPAYGMFGRVRERHGPTHNDFACPHGHFPTKEDGKWVAISCVTDKLFERLAIAMGRPELAAPHVYGDQKTRLDNRHDVNEIVRDWCGSLHREEILARCFAAGAPAGPLNSIADIFGDRQFHSRRNLVAIDEPDIGETVIVPSVLPRLSATPGRIKHLGPRLGQHTDEVLSGLLGLDEHEIDALRKKRVI

SEQ ID NO: 135 - DNA, 1227 bp, Rhodospirillum rubrum
  CDS (1)..(1227)
atgaccgtttcccctccgccgccgcccgccgccccggtccggccgcttgccggtttgcgcgtgcttgacgccgccaccttcatcgccgcccccttcgccgccggcttgcttggcgaattcggcgccgaggtcatcaagatcgaacaccccgcgggcggcgatccctttcgccgcttcggcacgatgaccgagcgcggcgacagcctggcttggctgtcggaggggcgcaacaaggcctctctcaccttggatctgcgcaagccgcaaggtgccgaggtgttccgcaagctggtcgccggcgccgatgtgctgtgcgagaactttcgcccgggaacgctggagaaatgggggctgggctgggaggttttatcggcgatcaaccccggcttggtgatgctgcgggtgtcgggctatggccaggacggcccctatcgcgactatccggggttcgcccgcatcgcccacgccttcggcgggctgacccatctggcgggcctgcccggcgggccgccggtgacgccgggatcaacctcgctgggcgactatatgagcggcctgtttggcgcctttggcgtgttgagcgccctgcgtcaccgcgacgcgaccgggcgcggccagcaggtcgatatcgcgctgtatgaaagcgtgttccgcgtgcttgatgaactggccccggcctatgcctatacgggcgcggtgcgcggacccgagggggcgggaacgctcaacgcctgcccgcacggccatttcccctgcgccagcggcggctgggtggccatcgcctgcaccaatgacaagatgttcgagcggctggcccgggtgatggggcgcccggccctggcctcgcccgaggtctgggggacgacggcccgacggctggccgagcgggccgccgtcgatgccctggtgagcgcctggacgggggctttggcgcggaccgaggttctggcgttgtgccatgccggcgaggtgccctgcggcccgatcaacgccatcgacgatatcttcgccgatccccatttccaggcgcgccagacgatggtcacgctgatcgaggcgcagcttggcgccatcgtcgttcccaatgttctgcccaagctttccgaaacccccggccgcatcgaccacctggggccgcgcctgggcgccgatagcgggcggattctgggtgagctggggctgagcgaggccgaaatcgccgatctgcgcgcccaaggggtggtgtga

SEQ ID NO: 136 - protein, 408 aa, Rhodospirillum rubrum
MTVSPPPPPAAPVRPLAGLRVLDAATFIAAPFAAGLLGEFGAEVIKIEHPAGGDPFRRFGTMTERGDSLAWLSEGRNKASLTLDLRKPQGAEVFRKLVAGADVLCENFRPGTLEKWGLGWEVLSAINPGLVMLRVSGYGQDGPYRDYPGFARIAHAFGGLTHLAGLPGGPPVTPGSTSLGDYMSGLFGAFGVLSALRHRDATGRGQQVDIALYESVFRVLDELAPAYAYTGAVRGPEGAGTLNACPHGHFPCASGGWVAIACTNDKMFERLARVMGRPALASPEVWGTTARRLAERAAVDALVSAWTGALARTEVLALCHAGEVPCGPINAIDDIFADPHFQARQTMVTLIEAQLGAIVVPNVLPKLSETPGRIDHLGPRLGADSGRILGELGLSEAEIADLRAQGVV

SEQ ID NO: 137 - DNA, 1209 bp, Magnetospirillum magneticum
  CDS (1)..(1209)
atggcccatccaaagcgccccctggacggtattcgcgtcctcgacatcgccaccttcatcgcggcgccctatgccgccgccattctgggcgaattcggtgccgaggtgatcaaggtggagcagccgggcggcggcgacaccttccgccgcttcggctccatcaccgagcgcgacggcgattcgctgatgtggctgtccgaggcgcgcaacaagaattcggtgaccctggacctgcgcaagcccgaaggccgcgagctgttcctcaaactggtggcccgcaccgacgtcatcgccgagaatttccgccccggcacgctcgagaaatggggactgggctgggaggagttgcgccgggtcaatccggggctgatcctgctgcgcatctcgggctatggccagaccggcccctacaaggaccgcccgggctttgcccgcatcgcccacgccttcggcggcctgtcctatctggccggcatgccgggcgacgtgccggtgacccccggctccacctccctggccgattacatgagcggcctttacggcgccatcggcgtgctgctggcgctgcggcaccgggatgccaccggcgagggtcaggtcatcgacctcgccctgtacgaatcggtgtttcgtgccctcgacgagatcgcccccgccttcgccatgttcggcaaggtgcgcgaacgtgaaggcgccggcacggtcaatgcctgcccccacggccatttccgttgcggcgatggcaagtgggtggcgctggcctgcaccaccgaccgcatgttcgcccggctggccgaggccatggagcgccccgaactggccgacggcgccaagtggggattgctgcgcaaccggctggccgagcgcgccgacgtggatgccctggtcggccattgggccgccacccgcccgcgcgagacggtgatggagctttgcctggacttcgaggtgcccgccgccccgctcaacaccatcgccgacatcttcgaggacccgcaattccaggcccgcggcaacctgctggaggtggccgatgcggtcctgggcggcgtcgtcgtgcccggcgtggtccccaagctttcggccacccccggccgggtcgaccatctcggcccccgcctgggcgaggacaacgcccgggtttatggcgggctgctgggtctcggcgaggccgagatcgccgagcttaagagcaaaggcgttatctga

SEQ ID NO: 138 - protein, 402 aa, Magnetospirillum magneticum
MAHPKRPLDGIRVLDIATFIAAPYAAAILGEFGAEVIKVEQPGGGDTFRRFGSITERDGDSLMWLSEARNKNSVTLDLRKPEGRELFLKLVARTDVIAENFRPGTLEKWGLGWEELRRVNPGLILLRISGYGQTGPYKDRPGFARIAHAFGGLSYLAGMPGDVPVTPGSTSLADYMSGLYGAIGVLLALRHRDATGEGQVIDLALYESVFRALDEIAPAFAMFGKVREREGAGTVNACPHGHFRCGDGKWVALACTTDRMFARLAEAMERPELADGAKWGLLRNRLAERADVDALVGHWAATRPRETVMELCLDFEVPAAPLNTIADIFEDPQFQARGNLLEVADAVLGGVVVPGVVPKLSATPGRVDHLGPRLGEDNARVYGGLLGLGEAEIAELKSKGVI

SEQ ID NO: 139 - DNA, 975 bp, Methylobacterium extorquens
  CDS (1)..(975)
atgagcttcaccctgatccagcaggccaccccgcgcctgcaccgctcggaactcgcggttcccggctccaacccgaccttcatggagaagtcggccgcctcgaaggccgacgtgatcttcctcgacctcgaggacgcggttgcgcccgacgacaaggagcaggcccgcaagaacatcatccaggccctcaacgacctggattggggcaacaagaccatgatgatccgcatcaacggtctcgacacccactacatgtaccgcgacgtggtggacatcgtggaggcctgcccgcgcctcgacatgatcctgatccccaaggtcggcgtgccggccgacgtctacgccatcgacgtgctgacgacgcagatcgagcaggccaagaagcgcgagaagaagatcggcttcgaggtgctgatcgagaccgcgctcggcatggccaatgtcgaggcgatcgcgacctcgtctaagcgccttgaggcgatgtccttcggtgtcgccgactacgccgcttccacccgcgcccgctccaccgtgatcggcggcgtcaacgccgattacagcgtgctcaccgacaaggacgaggccggcaaccgccagacccactggcaggatccgtggctgttcgcccagaaccgcatgctggtcgcctgccgcgcctacggcctgcgcccgatcgacggtcccttcggcgacttctccgatccggacggctacacctcggccgctcgccgctgcgccgcgctcggcttcgagggcaagtgggcgatccacccctcgcagatcgatctcgccaacgaggtcttcaccccctccgaggccgaggtcaccaaggcccgccgcatcctggaagccatggaagaggccgccaaggccggccgcggcgccgtctcgctcgacggccgtctcatcgacatcgcctcgatccgcatggccgaggcgctgatccagaaggccgacgcgatgggcggaaagtaa

SEQ ID NO: 140 - protein, 324 aa, Methylobacterium extorquens
MSFTLIQQATPRLHRSELAVPGSNPTFMEKSAASKADVIFLDLEDAVAPDDKEQARKNIIQALNDLDWGNKTMMIRINGLDTHYMYRDVVDIVEACPRLDMILIPKVGVPADVYAIDVLTTQIEQAKKREKKIGFEVLIETALGMANVEAIATSSKRLEAMSFGVADYAASTRARSTVIGGVNADYSVLTDKDEAGNRQTHWQDPWLFAQNRMLVACRAYGLRPIDGPFGDFSDPDGYTSAARRCAALGFEGKWAIHPSQIDLANEVFTPSEAEVTKARRILEAMEEAAKAGRGAVSLDGRLIDIASIRMAEALIQKADAMGGK

SEQ ID NO: 141 - DNA, 957 bp, Mesorhizobium loti
  CDS (1)..(957)
atgagccacaccatcaaccatttgaaaaaattgcggctgcagcgcagcgagctggcggttcccggttccagcccggagatgatcgacaaggcggccaacagcgccgccgacttcgtcttcctcgacatcgaggacgcggtcgccccgcccgacaaggaacgcgcccgcaagaacatcatccaggcgctgaacgacatcgactggcgtgccatgggcaagaccgtctcggtgcgcatcaatgggctcgacacccattacatgtaccgcgacgtggtcgacgtcatggaacaggccggcgaccggctggacacgatcctcgtgccaaaggtcggcgtgccggccgacctctacatggtcgaggccatggtcaaccagatcgagatggccaagggtttcaagacccgtgtcggcttggaagcgctgatcgaaacagcgctcggcatggccaatgtcgaagcgattgccgccactcccggccggctggaagccatgcatttcggcgtcgccgactatgcggcgagttgcaaggcgcgcaccgtcaacattggcggcctcaacccggactatcccggcgaccagtggcatttcgcgctatcgcgcatgacggtcgcctgccgcgcctatggcctgcgcgccattgacgggccattcggcgatttctccgatccggagggctacatcgccggcgccaggcgcgccgcggccctcggcatcgaaggcaaatgggcgatccacccgtcgcagatcgcgctcgccaacgacgtcttctcgccgccggaaaaggaggtcgcgcgggccaggcgcatccttgaggtgctcaaggaagccgaggccctgggcaaaggcgccgccgcactcgacggcaagatgatcgacgccgcgtcggaacgcatggcgaggaacgtcctggtggtcaacgaggccatcgaacgcgccggccaaaccgccacgcattga

SEQ ID NO: 142 - protein, 318 aa, Mesorhizobium loti
MSHTINHLKKLRLQRSELAVPGSSPEMIDKAANSAADFVFLDIEDAVAPPDKERARKNIIQALNDIDWRAMGKTVSVRINGLDTHYMYRDVVDVMEQAGDRLDTILVPKVGVPADLYMVEAMVNQIEMAKGFKTRVGLEALIETALGMANVEAIAATPGRLEAMHFGVADYAASCKARTVNIGGLNPDYPGDQWHFALSRMTVACRAYGLRAIDGPFGDFSDPEGYIAGARRAAALGIEGKWAIHPSQIALANDVFSPPEKEVARARRILEVLKEAEALGKGAAALDGKMIDAASERMARNVLVVNEAIERAGQTATH

SEQ ID NO: 143 - DNA, 996 bp, Granulibacter bethesdensis
  CDS (1)..(996)
ttgtccaaaaaaggggaggaagccatgagcttcacgctggtcgaacaagcaacgccgcgcctgcatcgctctgaactggcggtgccgggttccaacacagccctgttcgagaaatcggcccgctccgccgctgacatcatcttcctcgattgcgaggacgcggtggcgccggatgagaaagatcaggcgcgcaagaacatcattcaggccctgaacgaaatcgactggggcaacaagaccatgatggtacgcatcaatggtctcgacacccactatatgtatcgcgatgtggtcgatatcgtcgaagcctgcccgcgtctcgatatgatcctgatcccgaaggtcggcacggctgccgatgtctatgccgtggacatgctggtgacgcagatcgaacaggccaagaagcgcgaaaagaagatcggcttcgaggttctgatcgaaaccgcactcggcatggcgaatgtggaagctatcgcccagtcttcgaagcgtctggaagccatgagcttcggcgtggccgactatgccgccagcacgcgcgcccgcaccaccgtgatcggcggcgtcaatcccgattacggcgtgctgactgatcgtgatgagagcggtaatcgcgattattactggatggatcagtggcatttcgcacagagccgcatgatggtggcctgccgtgcttacggtctgcgcccgattgatggcccgttcggcgatttcaacgatccggaaggctatcgcgctgctgcccgtcgcgccgccgtgctcggttatgaaggcaaatgggcgatccacccgagccagatcgcactggcgaacgaggtgttttctccgtccgaagcggaagtgaccaaggcgcgccggattctggaagccatggaacaggccgccaaggaaggtcgtggcgctgtatcactggatggccgtctgatcgatatcgcgtccatccgtatggcggaagcgctgctggccaaggccaaccagatctccggctaa

SEQ ID NO: 144 - protein, 331 aa, Granulibacter bethesdensis
MSKKGEEAMSFTLVEQATPRLHRSELAVPGSNTALFEKSARSAADIIFLDCEDAVAPDEKDQARKNIIQALNEIDWGNKTMMVRINGLDTHYMYRDVVDIVEACPRLDMILIPKVGTAADVYAVDMLVTQIEQAKKREKKIGFEVLIETALGMANVEAIAQSSKRLEAMSFGVADYAASTRARTTVIGGVNPDYGVLTDRDESGNRDYYWMDQWHFAQSRMMVACRAYGLRPIDGPFGDFNDPEGYRAAARRAAVLGYEGKWAIHPSQIALANEVFSPSEAEVTKARRILEAMEQAAKEGRGAVSLDGRLIDIASIRMAEALLAKANQISG

SEQ ID NO: 145 - DNA, 1305 bp, Escherichia coli
  CDS (1)..(1305)
atgaaaacccgtacacaacaaattgaagaattacagaaagagtggactcaaccgcgttgggaaggcattactcgcccatacagtgcggaagatgtggtgaaattacgcggttcagtcaatcctgaatgcacgctggcgcaactgggcgcagcgaaaatgtggcgtctgctgcacggtgagtcgaaaaaaggctacatcaacagcctcggcgcactgactggcggtcaggcgctgcaacaggcgaaagcgggtattgaagcagtctatctgtcgggatggcaggtagcggcggacgctaacctggcggccagcatgtatccggatcagtcgctctatccggcaaactcggtgccagctgtggtggagcggatcaacaacaccttccgtcgtgccgatcagatccaatggtccgcgggcattgagccgggcgatccgcgctatgtcgattacttcctgccgatcgttgccgatgcggaagccggttttggcggtgtcctgaatgcctttgaactgatgaaagcgatgattgaagccggtgcagcggcagttcacttcgaagatcagctggcgtcagtgaagaaatgcggtcacatgggcggcaaagttttagtgccaactcaggaagctattcagaaactggtcgcggcgcgtctggcagctgacgtgacgggcgttccaaccctgctggttgcccgtaccgatgctgatgcggcggatctgatcacctccgattgcgacccgtatgacagcgaatttattaccggcgagcgtaccagtgaaggcttcttccgtactcatgcgggcattgagcaagcgatcagccgtggcctggcgtatgcgccatatgctgacctggtctggtgtgaaacctccacgccggatctggaactggcgcgtcgctttgcacaagctatccacgcgaaatatccgggcaaactgctggcttataactgctcgccgtcgttcaactggcagaaaaacctcgacgacaaaactattgccagcttccagcagcagctgtcggatatgggctacaagttccagttcatcaccctggcaggtatccacagcatgtggttcaacatgtttgacctggcaaacgcctatgcccagggcgagggtatgaagcactacgttgagaaagtgcagcagccggaatttgccgccgcgaaagatggctataccttcgtatctcaccagcaggaagtgggtacaggttacttcgataaagtgacgactattattcagggcggcacgtcttcagtcaccgcgctgaccggctccactgaagaatcgcagttctaa

SEQ ID NO: 146 - protein, 434 aa, Escherichia coli
MKTRTQQIEELQKEWTQPRWEGITRPYSAEDVVKLRGSVNPECTLAQLGAAKMWRLLHGESKKGYINSLGALTGGQALQQAKAGIEAVYLSGWQVAADANLAASMYPDQSLYPANSVPAVVERINNTFRRADQIQWSAGIEPGDPRYVDYFLPIVADAEAGFGGVLNAFELMKAMIEAGAAAVHFEDQLASVKKCGHMGGKVLVPTQEAIQKLVAARLAADVTGVPTLLVARTDADAADLITSDCDPYDSEFITGERTSEGFFRTHAGIEQAISRGLAYAPYADLVWCETSTPDLELARRFAQAIHAKYPGKLLAYNCSPSFNWQKNLDDKTIASFQQQLSDMGYKFQFITLAGIHSMWFNMFDLANAYAQGEGMKHYVEKVQQPEFAAAKDGYTFVSHQQEVGTGYFDKVTTIIQGGTSSVTALTGSTEESQF

SEQ ID NO: 147 - DNA, 1302 bp, Pantoea ananatis
  CDS (1)..(1302)
atgacacgtactcaacatattcagcaacttgaaaaacagtggcaggacgcgcgctggcagggcattacccgcccgtacagcgcagaggaagtgattaacctgcggggctctgttgtgccggcctgtactctggcagagcggggggcggtgaagctctggtcgctgctcaatggcgacgccaaaaaaggctatatcaacagtctgggagcattaacgggcggtcaggctctgcaacaggcaaaggccggtatagaagcgatctacctgtctggctggcaggtcgctgccgatgccaacgtagcagggcaaatgtatccggatcagtcgctttatccggtcaactccgtgcctgaggtggtcacccgtattaatcagacattccagcgcgccgatcagattcagtgggctaacggcacagaaccgggggacagccgctatatcgactattttctgcctatagtcgccgatgcagaagcgggctttggtggcgtgctgaatgcgtttgaactgatgaagtcattgatcagcgcaggcgcggcggccgtgcactttgaagatcaactggcggcggtgaagaaatgcggtcatatgggcggtaaggtgctggtgccaacccaggaggcgatacagaagctggtggcggcgcgtctggctgccgatgtcatgggcgtacccacgatcctgctggcgcggaccgatgcggatgccgcagacctgatcacgtctgactgtgacgaatacgaccgcccatttatacgcggcgaccgcacggcggaaggtttcttccgcaccaacgccggcattgagcaggcaatcagccgtggactggcttacgccccttacgccgatgtcctttggtgtgaaacctccaccccggatttggccatggcccagcgttttgccgatgcgattcacgcccgctatccaggcaagctgctggcttacaactgttcgccttcgtttaactggaaaaagaatctggatgacaaaaccattgctgccttccagcaggcgctcagtgacatgggctatcgctttcagttcattacgctggcgggcatccacagcatgtggttcaacatgttcgatcttgcgcacgcttacgctcagggcgaaggcatgcgccactatgtggaaaaagttcagcagccggagtttgctgcgcgcgaacggggttacagcttttcatcgcatcagcaggaggtcggaacaggctatttcgatcaggtgaccaacacgattcagggcggcaagtcatcggtgacggccctgacagggtccaccgaggagcatcagttttga

SEQ ID NO: 148 - protein, 433 aa, Pantoea ananatis
MTRTQHIQQLEKQWQDARWQGITRPYSAEEVINLRGSVVPACTLAERGAVKLWSLLNGDAKKGYINSLGALTGGQALQQAKAGIEAIYLSGWQVAADANVAGQMYPDQSLYPVNSVPEVVTRINQTFQRADQIQWANGTEPGDSRYIDYFLPIVADAEAGFGGVLNAFELMKSLISAGAAAVHFEDQLAAVKKCGHMGGKVLVPTQEAIQKLVAARLAADVMGVPTILLARTDADAADLITSDCDEYDRPFIRGDRTAEGFFRTNAGIEQAISRGLAYAPYADVLWCETSTPDLAMAQRFADAIHARYPGKLLAYNCSPSFNWKKNLDDKTIAAFQQALSDMGYRFQFITLAGIHSMWFNMFDLAHAYAQGEGMRHYVEKVQQPEFAARERGYSFSSHQQEVGTGYFDQVTNTIQGGKSSVTALTGSTEEHQF

SEQ ID NO: 149 - DNA, 1299 bp, Corynebacterium glutamicum
  CDS (1)..(1299)
atgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactag

SEQ ID NO: 150 - protein, 432 aa, Corynebacterium glutamicum
MSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARTEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 151 - DNA, 555 bp, Corynebacterium glutamicum
  CDS (1)..(555)
gtgtactcaatttcagaaactatcgcccgaactcttatgccccgcaccgatcacgttttcgacctgatgggcaacggaaacgcctggttcgtcgatgccctagaacgcctcgggcgaggcatcatcaccgtccgccccacagttgaaaccgtggccgccgcggacacctaccaccgcgtcacccgccgcccggcggtcgctaccaccacctatggtgctggtttcaccaacaccatgaccacgcttgccgacgtcgccctctcccgtatcccacttcttttagttgtgggcactgccccgagcgccgggcctcgctgtttcgacattgaccggcaaggactcgcacgtgccgtaggtgtggaaaccttcaccgtgcatgcagatgacgttgctgcggtaactcttcaggcttggaataatacgccggaaaacacacacgtgatcctggaaatcccctatgacctagcagctgccacagccaccgatccaacagtgactacatacctgctgcgccccggatttcagaaactcccgatgtcaccgaccttgtcctag

SEQ ID NO: 152 - protein, 184 aa, Corynebacterium glutamicum
MYSISETIARTLMPRTDHVFDLMGNGNAWFVDALERLGRGIITVRPTVETVAAADTYHRVTRRPAVATTTYGAGFTNTMTTLADVALSRIPLLLVVGTAPSAGPRCFDIDRQGLARAVGVETFTVHADDVAAVTLQAWNNTPENTHVILEIPYDLAAATATDPTVTTYLLRPGFQKLPMSPTLS

SEQ ID NO: 153 - DNA, 1347 bp, Corynebacterium glutamicum
  CDS (1)..(1347)
gtggttggcaccgcccattgcgaatcagcacttaaggaagtgactttgatgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggttgcaggtgacgccaacctctccggccacacctaccctgaccagtccctctacccagcgaactccgttccaagcgtcgttcgtcgcatcaacaacgcactgctgcgttccgatgaaatcgcacgctccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactgggagctatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactag

SEQ ID NO: 154 - protein, 448 aa, Corynebacterium glutamicum
MVGTAHCESALKEVTLMSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARSEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 155 - DNA, 555 bp, Corynebacterium glutamicum
  CDS (1)..(555)
gtgtactcaatttcagaaactatcgcccgaaatcttatgccccgcaccgatcacgttttcgacctgatgggcaacggaaacgcctggttcgtcgatgccctagaacgcctcgggcgaggcatcatcaccgtccgccccacagttgaaaccgaggccgccgcggacacctaccaccgcgtcacccgccgcccggcggtcactaccaccacctatggtgctggtttcaccaacaccatgaccacgcttgccgacgtcgccctctcccgtatcccacttcttttggttgtgggcactgccccgagcgccgggcctcgctgtttcgatattgaccggcaaggactcgcacgtgccgtaggcgtggaaaccttcaccgtgcatgcagatgacgttgctgcgataactcttcaggcttggaataatacgccggaaaacacacacgtgatcctggaaatcccctatgacctagcagctgccacagccaccgatccaacagtgactacatacctgctgcgccccggatttcagaaactcccgatgtcaccgaccttgtcctag

SEQ ID NO: 156 - protein, 184 aa, Corynebacterium glutamicum
MYSISETIARNLMPRTDHVFDLMGNGNAWFVDALERLGRGIITVRPTVETEAAADTYHRVTRRPAVTTTTYGAGFTNTMTTLADVALSRIPLLLVVGTAPSAGPRCFDIDRQGLARAVGVETFTVHADDVAAITLQAWNNTPENTHVILEIPYDLAAATATDPTVTTYLLRPGFQKLPMSPTLS

SEQ ID NO: 157 - DNA, 771 bp, Escherichia coli
  CDS (1)..(771)
atgcaaactgagcaacagcgagccgtaacacggctttgtatccagtgtggattatttcttttgcaacatggtgcggaaagcgcgttggttgatgagctttcctcacgactgggtcgggcactgggaatggacagcgtcgaaagttctatctcttcgaacgccatagtgctgacaactattaaagatgggcaatgcctgacatcgacacgtaaaaatcacgatcgcggcattaatatgcatgtggtgactgaagtccagcacattgtgattcttgcggagcatcatctgctggattacaaaggcgtagagaaacgatttagccaaattcagccattacgttacccaagatggctggtagccttaatggttggcctttcttgcgcctgtttctgtaaactcaataacggtggctgggatggtgccgtcatcaccttctttgccagtacgaccgcgatgtatatccgccagctgctggcacaacgtcatcttcatccacagatcaacttttgccttaccgctttcgccgccaccaccatttccggattgcttttgcaactccccactttcagcaatacccccaccattgcgatggccgccagcgttctgctgctagtgccgggctttccgttgattaatgccgtcgccgatatgtttaaaggccacatcaataccggactggcacgctgggcgatcgccagtctgctgacactggctacctgcgtcggcgtagtgatggcactgacgatttgggggctacgcggatgggtgtga

SEQ ID NO: 158 - protein, 256 aa, Escherichia coli
MQTEQQRAVTRLCIQCGLFLLQHGAESALVDELSSRLGRALGMDSVESSISSNAIVLTTIKDGQCLTSTRKNHDRGINMHVVTEVQHIVILAEHHLLDYKGVEKRFSQIQPLRYPRWLVALMVGLSCACFCKLNNGGWDGAVITFFASTTAMYIRQLLAQRHLHPQINFCLTAFAATTISGLLLQLPTFSNTPTIAMAASVLLLVPGFPLINAVADMFKGHINTGLARWAIASLLTLATCVGVVMALTIWGLRGWV

SEQ ID NO: 159 - DNA, 777 bp, Enterobacter aerogenes
  CDS (1)..(777)
atgcaggcagataaatcagagcagcgcgccgtcacccggttgtgcatccagtgtgccctttacttactccagcacggtgcggaaagcgcgctggttgaggagctttctacccgcctcgggcgggcgttaggtatggatagcgttgaaagcgctatctcctctaatgcgatcgtgctcaccacgattaaagacggcgaatgtctcacctccacgcgtaaaaacagcgatcgcggaattaacatgcatgtggtgacggaggtacagcatattgtgatcatggccgaacataagctgttggattacaaagacgtcgagaagcgcttctcgcagatcaaacccttacgctacccgcgctggctactggtattaatggtcggcctctcctgcgcctgcttttgtaaattgaacaacggcggttgggatggcgcggtggttaccttcttcgccagtaccgtcgccatgtatattcgccaactgctaacccaccgttccatgcatccgcagattaatttctgcattactgcctttgtcgccaccaccatttccgggctgatgctgcgtctgccggcatttagcgagacgccgactatcgccatggccgccagcgtgctgttgctggttcccggctttccgttaattaacgccgtggccgatatgttcaagggccatatcaataccgggctggcccgctgggcgatcgccagcctgctgacgctggcgacctgtatcggggtggtaatggcaatgaccatgtgggggctacgcggatgggcataa

SEQ ID NO: 160 - protein, 258 aa, Enterobacter aerogenes
MQADKSEQRAVTRLCIQCALYLLQHGAESALVEELSTRLGRALGMDSVESAISSNAIVLTTIKDGECLTSTRKNSDRGINMHVVTEVQHIVIMAEHKLLDYKDVEKRFSQIKPLRYPRWLLVLMVGLSCACFCKLNNGGWDGAVVTFFASTVAMYIRQLLTHRSMHPQINFCITAFVATTISGLMLRLPAFSETPTIAMAASVLLLVPGFPLINAVADMFKGHINTGLARWAIASLLTLATCIGVVMAMTMWGLRGWA

SEQ ID NO: 161 - DNA, 474 bp, Escherichia coli
  CDS (1)..(474)
atgggtgtgatcgaatttctgttagcgttggcgcaggatatgatcctcgccgccattcctgcggtcggctttgcgatggtgttcaacgttcccgtgcgggcgttacgctggtgtgcgctgcttggctcgataggtcatggttcccgaatgatcttgatgaccagcgggttgaatattgagtggtcaacctttatggcttctatgctggtcggtaccattggtattcaatggtcgcgctggtatctggcgcatccgaaagtgtttaccgtggcggccgttatccctatgttcccgggcatatcggcttataccgcaatgatttcggcggtaaaaatcagccagttaggttacagcgaaccgttgatgattaccctgttaaccaactttcttacagcttcatcgattgttggtgcgttatccatcggtctttccattcctggattatggttgtaccgcaagcgccctcgcgtataa

SEQ ID NO: 162 - protein, 157 aa, Escherichia coli
MGVIEFLLALAQDMILAAIPAVGFAMVFNVPVRALRWCALLGSIGHGSRMILMTSGLNIEWSTFMASMLVGTIGIQWSRWYLAHPKVFTVAAVIPMFPGISAYTAMISAVKISQLGYSEPLMITLLTNFLTASSIVGALSIGLSIPGLWLYRKRPRV

SEQ ID NO: 163 - DNA, 474 bp, Enterobacter aerogenes
  CDS (1)..(474)
atgggcataatctcttatcttttcgacctggcgcaggatatggcgctggcggccatccctgctgtcggctttgcgatggtgttcaacgtcccacagcgcgcgctgcgctggtgcgcgttactgggcgctatcggccacggctcgcggatggtgatgatgagcgcaggcttcaatatagaatgggccacctttctcgccgcgttactggtcggtagtataggcattcagtggtcgcgctggtatctggcgcacccgaagatatttaccgtcgccgcggtgatcccgatgttccctgggatttcggcttatacggcgatgatctcggccgtcaaaatcagccattttggttactccgaagagatgatgattatgctgttgagcaactttttaaaagcctcctccatcgtcggggcgctctctatcgggctgtctattcccggtctgtggctctatcgcaaacgcccgcgcgtgtaa

SEQ ID NO: 164 - protein, 157 aa, Enterobacter aerogenes
MGIISYLFDLAQDMALAAIPAVGFAMVFNVPQRALRWCALLGAIGHGSRMVMMSAGFNIEWATFLAALLVGSIGIQWSRWYLAHPKIFTVAAVIPMFPGISAYTAMISAVKISHFGYSEEMMIMLLSNFLKASSIVGALSIGLSIPGLWLYRKRPRV

SEQ ID NO: 165 - DNA, 1059 bp, Escherichia coli
  CDS (1)..(1059)
gtgcgtgccgataagtcattaagcccgtttgaaatccgggtataccgccattaccgcattgtgcatggtactcgggtcgcgctggcattcctgctcacttttctcattatccgcctgtttactatcccggaaagcacctggccgctggtcaccatggtggtgattatggggccaatctcgttctggggtaacgttgtccctcgcgcctttgagcgtattggcggtacggtgttgggttcgattttaggtcttatcgctctgcaactggagttaatctcgttaccgctgatgttagtctggtgcgcggcggccatgttcctttgcggttggctggcgctgggcaagaaaccgtatcaaggtttattgattggggtgacgctggcaattgttgtgggttccccgacaggtgaaattgatacggcgttatggcgaagcggcgatgtgatcctcggctctttactggcaatgttgtttaccggtatctggccacaacgggcgttcatccactggcgcattcaactggcgaaaagtctgaccgagtataatcgggtctatcaatctgcattctcaccgaacttactcgaacgcccacgtctggaaagccatctacaaaaactcctgaccgatgccgtgaaaatgcgtggactgattgcgcccgccagcaaagaaacccgtattccaaaatcgatatatgaaggtatccagaccattaaccgcaatctggtttgtatgctggagttgcaaatcaatgcatactgggccacgcgccccagccatttcgtgttattgaacgcgcaaaaacttcgtgatacccagcacatgatgcagcaaatactgctgagccttgttcatgcgctgtacgaaggtaatccgcagccggtttttgccaatacggaaaaattgaacgatgctgtggaagagctgcgtcagttgctcaataaccaccatgacctgaaggttgtggaaacaccaatctatggttatgtgtggctgaacatggaaacggcgcatcagcttgagttgctatcgaatctgatttgccgggccttgcgcaaataa

SEQ ID NO: 166 - protein, 352 aa, Escherichia coli
MRADKSLSPFEIRVYRHYRIVHGTRVALAFLLTFLIIRLFTIPESTWPLVTMVVIMGPISFWGNVVPRAFERIGGTVLGSILGLIALQLELISLPLMLVWCAAAMFLCGWLALGKKPYQGLLIGVTLAIVVGSPTGEIDTALWRSGDVILGSLLAMLFTGIWPQRAFIHWRIQLAKSLTEYNRVYQSAFSPNLLERPRLESHLQKLLTDAVKMRGLIAPASKETRIPKSIYEGIQTINRNLVCMLELQINAYWATRPSHFVLLNAQKLRDTQHMMQQILLSLVHALYEGNPQPVFANTEKLNDAVEELRQLLNNHHDLKVVETPIYGYVWLNMETAHQLELLSNLICRALRK

SEQ ID NO: 167 - DNA, 1056 bp, Pantoea ananatis
  CDS (1)..(1056)
ttgcgctctgataagcccatctctaatctggaattctggttatatcgccattaccgtagcgtgcacggcttgcgcatcgcggtggcgtttctttttgcctttttgtttgtgcggatgaccggcattcccgaaggcacctggccgctgattacgctggtggtggtgatggggccgatctccacgtggggcaatgtgtttccccgcgccattcagcgcattggcggcacgattgccgggtcaatttcgggattgattgcgctcaagctggagatgatttcgctaccgggcatgctggcctggtgcgcgctgatcatgtttatcagcggctatctgaccctgggaaagcatccctatatggcgctgttgattggcattacgctctgcgtagtggtcggcgcgccaatgggggatttcaccgtcgccatgtggcgtggcggcgatgtgattttaggctcgctgctggcgctgatatttaccgctgtctgggcacagcgcgcctacattcactggcgtatccagctttcggatacgctgggcgagatggcaaaaatctatcatgcaggtttttccgctaacctggtggaaaagccgcgactgaataagccctttgggaagttgctctccagcgtcatcaaaatgcgcgcgctgttggagccgtccagcaaagaaacgcgtattcctaaatcggtatttgaagcgattcagaccataaaccgtaatatggtgtacaccattgagatgcaaattaatgcctggtgggcatcgagggaaagccatctgattatgctgaatgcgccgacgctgcgccgtactcagcagatgacggaaaacgcgctacgaacgttgtcggagatggcggtgaaaggggaaacctatgacatcatcgcggccaaccatgagttaacggaaatcgtcaatgaacttaagcagttgatcgccagcggcagtgaccgtctggaggaaacgccaatttatggctatgtctggttgagtctggagctggcgaagcaactggagcgcatgacggacttactgcgtctggcgctgcgtaaataa

SEQ ID NO: 168 - protein, 351 aa, Pantoea ananatis
MRSDKPISNLEFWLYRHYRSVHGLRIAVAFLFAFLFVRMTGIPEGTWPLITLVVVMGPISTWGNVFPRAIQRIGGTIAGSISGLIALKLEMISLPGMLAWCALIMFISGYLTLGKHPYMALLIGITLCVVVGAPMGDFTVAMWRGGDVILGSLLALIFTAVWAQRAYIHWRIQLSDTLGEMAKIYHAGFSANLVEKPRLNKPFGKLLSSVIKMRALLEPSSKETRIPKSVFEAIQTINRNMVYTIEMQINAWWASRESHLIMLNAPTLRRTQQMTENALRTLSEMAVKGETYDIIAANHELTEIVNELKQLIASGSDRLEETPIYGYVWLSLELAKQLERMTDLLRLALRK

SEQ ID NO: 169 - DNA, 1059 bp, Enterobacter aerogenes; identical to SEQ ID NO: 165
  CDS (1)..(1059)

SEQ ID NO: 170 - protein, 352 aa, Enterobacter aerogenes; identical to SEQ ID NO: 166

SEQ ID NO: 171 - DNA, 1254 bp, Escherichia coli
  CDS (1)..(1254)
gtgagccgtactacaactgttgatggcgctccggcaagcgacactgacaagcaaagcatttctcagccaaatcaatttattaaacgcggtacgccgcaatttatgcgcgtcaccctggcgctgttctctgccggactggcaacatttgcacttctctattgtgtgcagcctatccttccggtgctttcgcaggagtttggcttaacccccgcgaacagtagtatttcactgtccatttccacggcgatgttggctattggtttgctgtttactggcccgctatccgatgccattggtcgcaaaccagtgatggtcacggcgctactgttggcctccatttgtacgttactttcgacaatgatgaccagctggcacggcattttgattatgcgcgccttgattgggctttcgttaagtggcgtggcagctgttggcatgacttatcttagcgaggaaatccatcccagtttcgtggccttttcaatggggttgtatatcagcggcaactcaattggcggcatgagcggacgcttaattagcggtgtcttcacggactttttcaactggcgaattgctctggcggcaatcggttgtttcgcgctggcctcggcgttgatgttctggaaaatcctccctgaatcacgccattttcgcccgacttcgctgcgccctaagacgttgtttatcaactttcgtctgcactggcgtgaccggggattaccgttattgttcgcagaaggctttttgctgatggggtcgttcgtcacgctgtttaattacatcggctatcggttgatgctctccccctggcatgtcagtcaggccgtggttggcttattatcgctggcttatttgaccggtacatggagctcacccaaagccggaaccatgaccacccgctatgggcgtggtccagtgatgttgttttcgacgggggttatgctgtttggtttactgatgaccttattcagctcgctgtggctgatctttgccggaatgttactcttctcagcaggattcttcgcagcccactcagtagccagcagctggatcggcccccgcgcaaaacgcgctaaaggccaggcctcctcgctgtatctgttcagttactatctggggtcgagtattgccgggacgctgggtggtgttttctggcataactatggctggaacggcgtcggcgcatttattgctctgatgctggtcattgctctgctggtcgggacgcgtttgcatcgtcgtctgcacgcctga

SEQ ID NO: 172 - protein, 417 aa, Escherichia coli
MSRTTTVDGAPASDTDKQSISQPNQFIKRGTPQFMRVTLALFSAGLATFALLYCVQPILPVLSQEFGLTPANSSISLSISTAMLAIGLLFTGPLSDAIGRKPVMVTALLLASICTLLSTMMTSWHGILIMRALIGLSLSGVAAVGMTYLSEEIHPSFVAFSMGLYISGNSIGGMSGRLISGVFTDFFNWRIALAAIGCFALASALMFWKILPESRHFRPTSLRPKTLFINFRLHWRDRGLPLLFAEGFLLMGSFVTLFNYIGYRLMLSPWHVSQAVVGLLSLAYLTGTWSSPKAGTMTTRYGRGPVMLFSTGVMLFGLLMTLFSSLWLIFAGMLLFSAGFFAAHSVASSWIGPRAKRAKGQASSLYLFSYYLGSSIAGTLGGVFWHNYGWNGVGAFIALMLVIALLVGTRLHRRLHA

SEQ ID NO: 173 - DNA, 1248 bp, Pantoea ananatis
  CDS (1)..(1248)
gtgaatcgctcttcacctgcggtgccgctggacagcgacatgcctgcgcagtctgaggcttcctcgtctgactggattgtgcgcggcacccggccttttatgcgcgtcacgctcgccttgttttctgccgggctggccacctttgccctgctgtattgcgtgcagcctattctgccggtgctctctgcacagtttggcatttctcccgccgcgagcagtatttcgctttccatttccaccgccatgatggccctgggattactggtgacaggcccgctgtccgatgccataggacggaagtccgtgatggtaacggcgctcatgctggccgcaatctgtaccctgctctctgccactatgaccagctggcacggcattttactgatgcggggcttgatcggcttatcgctgagcggtgtggccgcggtgggcatgacctatctgagtgaagagattcatcccagtgtggtggctttttcgatggggctgtacatcagcggaaactcgattggcggcatgagcggccgcctgataagcggtgtattaaccgacttcttttcatggcgcatagccattgcggccattggctgttttgccctcgccgctgccctgatgttctggagaatcttaccggaatcgcgccatttccgtccggcctcgctgcgcccgcgtcatctgaccattaacttccgtctgcactggcgcgatgcgggattgccgctgctgtttgctgaaggcctgctgctgatgggcgcctttgtgacgctgttcaactatatcggctatcgcctgctgggcgcgccgtggcatttaagtcaggctgtggtgggcttgctgtcggtggtttatctgaccgggtcatggagttcccctaaagccggcgcgttaaccagccggtttgggcgcggcccggttatgtttggctcgacctttattatgctgatggggttactgctgacggcatttaacggtatcgtgctgatcttcattggtatgatgctgtttacggcaggatttttcgctgcgcactccgtggcgagcggctggattggcccacgcgctcgtcgggcaaaaggtcaggcttcttcgctctatctgttcagctattacgtcggctcaagcgtggcgggtacagctggcggctttttctggcatcagtttggctggggcggcctgacactgtttatctccgctttactgctgttagcgttgtgggttgcctggcagctgcaccgccgcaaactctag

SEQ ID NO: 174 - protein, 415 aa, Pantoea ananatis
MNRSSPAVPLDSDMPAQSEASSSDWIVRGTRPFMRVTLALFSAGLATFALLYCVQPILPVLSAQFGISPAASSISLSISTAMMALGLLVTGPLSDAIGRKSVMVTALMLAAICTLLSATMTSWHGILLMRGLIGLSLSGVAAVGMTYLSEEIHPSVVAFSMGLYISGNSIGGMSGRLISGVLTDFFSWRIAIAAIGCFALAAALMFWRILPESRHFRPASLRPRHLTINFRLHWRDAGLPLLFAEGLLLMGAFVTLFNYIGYRLLGAPWHLSQAVVGLLSVVYLTGSWSSPKAGALTSRFGRGPVMFGSTFIMLMGLLLTAFNGIVLIFIGMMLFTAGFFAAHSVASGWIGPRARRAKGQASSLYLFSYYVGSSVAGTAGGFFWHQFGWGGLTLFISALLLLALWVAWQLHRRKL

SEQ ID NO: 175 - DNA, 1251 bp, Enterobacter aerogenes
  CDS (1)..(1251)
gtgagtaacacaacaaccgctgacaccgcgccggcgagcgatgtcagggataaggtcgcttcccagccaaatcaatttattaaacgcggcaccccggcgtttatccgcgtcaccctggcgctattttccgccggactggccaccttcgccctgctctattgcgtgcagcccattctgccggtgctgtcaggcgagttcggcgtaagcccggccagcagcagtatttcgttatcgatttccaccgcgatgctcgccatcggcctgctatttaccggcccgctgtcggatgccattggccgtaaaccggtaatggtcaccgccttactgttggcggcgtgttgctcattattatcaacgatgatgaccagctggcacggtattctgatcatgcgcgcgttgatcggcctgtcgctcagcggcgtagccgccgtagggatgacttatctcagcgaggagatccacccaagcgtggtggcgttttcaatggggctttatatcagcggtaactcgataggcggcatgagcggccgcctgctcaccggggtctttaccgatttcttcggctggcgcgtggcgctggcggtgataagcgccttcgccctcgctgcggcaatcatgttctggcgtattcttcccgagtcgcgccacttccgccctatttcgttgaaaccgaaaacgctgctgattaacttccatctgcactggcgcgatcgcggcctgccgctgttgttcctcgaaggcttcctgctgatgggcgcatttgtgaccctgtttaactatattggctaccgtttgatgatgtcgccatggtcgctgaatcaggcggtggttggcctgctgtcggttgcttacctgaccgggacctggagttcgccaaaagccggcgcgctgacggtgcgttatggccgcggtccagtaatgttgttctttattgcggtgatgctgtttggcctgctgatgacgctattctcgccgctgtggctgattttcatcggcatgctgctgttctccgccggcttttttgccgcgcactcggtcgccagcagttggatcggaccacgggcgcgtcgcgcgcgcggccaggcatcttcgttatacctgttcagctactatcttggctcaagtattgcggggacgctcggtggggtcttctggcatcattacggctggaatggcgtcggcggctttatcgccctgctgttaatggccgcgctgctgaccggcgcctgtttgcacaaccgcctgaaataa

SEQ ID NO: 176 - protein, 416 aa, Enterobacter aerogenes
MSNTTTADTAPASDVRDKVASQPNQFIKRGTPAFIRVTLALFSAGLATFALLYCVQPILPVLSGEFGVSPASSSISLSISTAMLAIGLLFTGPLSDAIGRKPVMVTALLLAACCSLLSTMMTSWHGILIMRALIGLSLSGVAAVGMTYLSEEIHPSVVAFSMGLYISGNSIGGMSGRLLTGVFTDFFGWRVALAVISAFALAAAIMFWRILPESRHFRPISLKPKTLLINFHLHWRDRGLPLLFLEGFLLMGAFVTLFNYIGYRLMMSPWSLNQAVVGLLSVAYLTGTWSSPKAGALTVRYGRGPVMLFFIAVMLFGLLMTLFSPLWLIFIGMLLFSAGFFAAHSVASSWIGPRARRARGQASSLYLFSYYLGSSIAGTLGGVFWHHYGWNGVGGFIALLLMAALLTGACLHNRLK

SEQ ID NO: 177 - DNA, 1251 bp, Corynebacterium glutamicum
  CDS (1)..(1251)
atgatgaactccatgagccaagcaatagatagcaaggtcgaggcacacgaaggccacgaaggttacaaaggcatcgagcgaggaacacgcaattacaagcgcgctgtgtttgcgatgctggccgccggtcttgctgctttcaatggtctttattgcacgcaggcattgcttcccaccatgacggaagagttgggaattacgcccactgagtccgcgctgacggtgtcggcgacaactggaatgttggcgctgtgcattgttccggcgtcgatactttcggagaaatttggccgcggtcgggtgctgacaatttcactcacgttggccatcatcgtgggattaattttgccgcttgtccccaatatcactgctctcatcctgctcagaggtctccaaggtgcgctgcttgctggcactccggcggtggcgatgacctggttgtctgaggaaattcaccccaaggatattgggcatgcgatgggaatttacatcgcgggaaatactgtcggcgggctcactggacgtatgattccggcgggactacttgaagtaactcattggcaaaacgcactgctgggaagttctatcgctgcgctaatcttcggcgtaatcatggtggtgttgcttcccaagcagcggaaattccagccgaagaatatcaatctgggccatgaggtttctgcgatggctgctcattggcggaatcctcgtttggctttgctctttggtactgcatttttgggcatgggtacttttgtgtcgctgtacaactatttgggtttccgcatgattgatcagtttgggctgagtgaagtgctggttggtgcagtgttcatcatgtatctggccgggacctggagttccacccaggcgggtgcgttgagggagaagattggcaatggacaaactgtcattttcttgagcctgatgatgatcgcctcgatggctctcatgggcattaacaatttgtggatcaccctcatcgcgctttttgtgttcacagcagcgtttttcgcactgcattccagtgcttcgggatggatcggaatcatcgcaacgaaggatcgcgcggaagcctccagcatgtatttgttctgttattacgtgggatcctcggtgattggttgggtttctggattcgcgtttacgcatttgccgtggttggcgttcattggctggttgattctgcttctttttggagtgctggcgatttgtgtgacgctggcaaggcttgcccgcaacgccaattaa

SEQ ID NO: 178 - protein, 416 aa, Corynebacterium glutamicum
MMNSMSQAIDSKVEAHEGHEGYKGIERGTRNYKRAVFAMLAAGLAAFNGLYCTQALLPTMTEELGITPTESALTVSATTGMLALCIVPASILSEKFGRGRVLTISLTLAIIVGLILPLVPNITALILLRGLQGALLAGTPAVAMTWLSEEIHPKDIGHAMGIYIAGNTVGGLTGRMIPAGLLEVTHWQNALLGSSIAALIFGVIMVVLLPKQRKFQPKNINLGHEVSAMAAHWRNPRLALLFGTAFLGMGTFVSLYNYLGFRMIDQFGLSEVLVGAVFIMYLAGTWSSTQAGALREKIGNGQTVIFLSLMMIASMALMGINNLWITLIALFVFTAAFFALHSSASGWIGIIATKDRAEASSMYLFCYYVGSSVIGWVSGFAFTHLPWLAFIGWLILLLFGVLAICVTLARLARNAN

SEQ ID NO: 179 - DNA, 1251 bp, Corynebacterium glutamicum; identical to SEQ ID NO: 177
  CDS (1)..(1251)

SEQ ID NO: 180 - protein, 416 aa, Corynebacterium glutamicum; identical to SEQ ID NO: 178

SEQ ID NO: 181 - DNA, 80 bp, Artificial Sequence
  primer
taaatcctacttttttaatgcgatccaatcattttaaggagtttaaaatgcgctcaagttagtataaaaaagctgaacga

SEQ ID NO: 182 - DNA, 80 bp, Artificial Sequence
  primer
tgtcccgaaacgggttcgtttcgggacaccgttaccgttaaacgttatcatgaagcctgcttttttatactaagttggca

SEQ ID NO: 183 - DNA, 30 bp, Artificial Sequence
  primer
attaggattttgttatttaaacacgagtcc

SEQ ID NO: 184 - DNA, 30 bp, Artificial Sequence
  primer
gtattcagaacaatattttccgttgctaat

SEQ ID NO: 185 - DNA, 80 bp, Artificial Sequence
  primer
taaatcctacttttttattgccttcaaataaatttaaggagttcgaaatgcgctcaagttagtataaaaaagctgaacga

SEQ ID NO: 186 - DNA, 80 bp, Artificial Sequence
  primer
gctgtttttttaaaggctgggcattcggtttttacaacgttatgttatcatgaagcctgcttttttatactaagttggca

SEQ ID NO: 187 - DNA, 30 bp, Artificial Sequence
  primer
cttaggattttgttatttaaattaagcctg

SEQ ID NO: 188 - DNA, 30 bp, Artificial Sequence
  primer
cgatgaatagacagccaatatattattgcg

SEQ ID NO: 189 - DNA, 38 bp, Artificial Sequence
  primer
acacaaggagactcccatggcacaccgtattaccgatg

SEQ ID NO: 190 - DNA, 41 bp, Artificial Sequence
  primer
tcgagtctccttgggctataccttgataatgcagtccaccg

SEQ ID NO: 191 - DNA, 39 bp, Artificial Sequence
  primer
cccaaggagactcgaatgagtgacaccgtaatcttaaac

SEQ ID NO: 192 - DNA, 46 bp, Artificial Sequence
  primer
ggaactggcggctcccgggtcagttgatcgtccaggtgctgttgcc

SEQ ID NO: 193 - DNA, 40 bp, Artificial Sequence
  primer
cccaaggagactcgaatgacccggacattcaagacaatgg

SEQ ID NO: 194 - DNA, 44 bp, Artificial Sequence
  primer
ggaactggcggctcccgggttatgcttcgccttcaatcgaacgg

SEQ ID NO: 195 - DNA, 19 bp, Artificial Sequence
  primer
cccgggagccgccagttcc

SEQ ID NO: 196 - DNA, 43 bp, Artificial Sequence
  primer
cattcgagtctccttgggtcagttgatcgtccaggtgctgttg

SEQ ID NO: 197 - DNA, 80 bp, Artificial Sequence
  primer
gatccgtctgtatcgtcattaccgaattgtgcacggtatccgcatcgcgctgaagcctgcttttttatactaagttggca

SEQ ID NO: 198 - DNA, 80 bp, Artificial Sequence
  primer
gccagctcaatggtcagccaaacatagccgtgaatcggcgtttccgacagcgctcaagttagtataaaaaagctgaacga

SEQ ID NO: 199 - DNA, 80 bp, Artificial Sequence
  primer
taaggtcgcttcccagccaaatcaatttattaaacgcggcaccccggcgttgaagcctgcttttttatactaagttggca

SEQ ID NO: 200 - DNA, 80 bp, Artificial Sequence
  primer
acttgagccaagatagtagctgaacaggtataacgaagatgcctggccgccgctcaagttagtataaaaaagctgaacga

SEQ ID NO: 201 - DNA, 80 bp, Artificial Sequence
  primer
ggacagacctgtgcgctgctctctaaagttttccctacccgttcccatactgaagcctgcttttttatactaagttggca

SEQ ID NO: 202 - DNA, 80 bp, Artificial Sequence
  primer
actctggcagatacagggaatggcacagccagttttcatcatcacgttcccgctcaagttagtataaaaaagctgaacga

SEQ ID NO: 203 - DNA, 80 bp, Artificial Sequence
  primer
ctctaatctggaattctggttatatcgccattaccgtagcgtgcacggcttgaagcctgcttttttatactaagttggca

SEQ ID NO: 204 - DNA, 80 bp, Artificial Sequence
  primer
gtgattatttacgcagcgccagacgcagtaagtccgtcatgcgctccagtcgctcaagttagtataaaaaagctgaacga

SEQ ID NO: 205 - DNA, 80 bp, Artificial Sequence
  primer
gacagcgacatgcctgcgcagtctgaggcttcctcgtctgactggattgttgaagcctgcttttttatactaagttggca

SEQ ID NO: 206 - DNA, 80 bp, Artificial Sequence
  primer
ttgagccgacgtaatagctgaacagatagagcgaagaagcctgaccttttcgctcaagttagtataaaaaagctgaacga

SEQ ID NO: 207 - DNA, 80 bp, Artificial Sequence
  primer
gcatatgtatgacaccgtcaaaggttccgactacatcggtgaccaggacgtgaagcctgcttttttatactaagttggca

SEQ ID NO: 208 - DNA, 80 bp, Artificial Sequence
  primer
tccagctcaaggcactcaatacgctgtgtattgaagtcaggtgagcggtccgctcaagttagtataaaaaagctgaacga

SEQ ID NO: 209 - DNA, 33 bp, Artificial Sequence
  primer
ggaagatctatttgccttcgcacatcaacctgg

SEQ ID NO: 210 - DNA, 30 bp, Artificial Sequence
  primer
cggggtaccttgtaaatattttaacccgcc

SEQ ID NO: 211 - DNA, 56 bp, Artificial Sequence
  primer
ggaagatctaaggagaccttaaatgagcgacacaacgatcctgcaaaacagtaccc

SEQ ID NO: 212 - DNA, 39 bp, Artificial Sequence
  primer
cggggtacctcgtagaggtttactggcgcttatccagcg

SEQ ID NO: 213 - DNA, 1617 bp, Actinobacillus succinogenes
  CDS (1)..(1617)
atgactgacttaaacaaactcgttaaagaacttaatgacttagggcttaccgatgttaaggaaattgtgtataacccgagttatgaacaacttttcgaggaagaaaccaaaccgggtttggagggtttcgataaagggacgttaaccacgcttggcgcggttgccgtcgatacggggatttttaccggtcgttcaccgaaagataaatatatcgtttgcgatgaaactacgaaagacaccgtttggtggaacagcgaagcggcgaaaaacgataacaaaccgatgacgcaagaaacttggaaaagtttgagagaattagtggcgaaacaactttccggtaaacgtttattcgtggtagaaggttactgcggcgccagtgaaaaacaccgtatcggtgtgcgtatggttactgaagtggcatggcaggcgcattttgtgaaaaacatgtttatccgaccgaccgatgaagagttgaaaaatttcaaagcggattttaccgtgttaaacggtgctaaatgtactaatccgaactggaaagaacaaggtttgaacagtgaaaactttgtcgctttcaatattaccgaaggtattcagcttatcggcggtacttggtacggcggtgaaatgaaaaaaggtatgttctcaatgatgaactacttcctgccgttaaaaggtgtggcttccatgcactgttccgccaacgtaggtaaagacggtgacgtggctattttcttcggtttatccggtacgggtaaaacaacgctttcgaccgatcctaaacgccaattaatcggtgatgacgaacacggttgggatgaatccggcgtatttaactttgaaggcggttgttacgcgaaaaccattaacttatctcaagaaaacgaaccggatatttacggcgcaatccgtcgtgacgcattattagaaaacgtcgtggttcgtgcagacggttccgttgactttgacgacggttcaaaaacagaaaatacccgtgtttcatatccgatttaccacatcgacaacatcgttcgtccggtatcgaaagccggtcatgcaaccaaagtgattttcttaaccgcggacgcattcggcgtattgccgccggtttcaaaactgactccggaacaaaccgaatactacttcttatccggctttactgcaaaattagcgggtacggaacgcggcgtaaccgaaccgactccgacattctcggcctgtttcggtgcggcattcttaagcctgcatccgattcaatatgcggacgtgttggtcgaacgcatgaaagcctccggtgcggaagcttatttggtgaacaccggttggaacggcacgggtaaacgtatttcaatcaaagatacccgcggtattatcgatgcgattttggacggttcaatcgaaaaagcggaaatgggcgaattgccaatctttaatttagcgattcctaaagcattaccgggtgttgatcctgctattttggatccgcgcgatacttacgcagacaaagcgcaatggcaagttaaagcggaagatttggcaaaccgtttcgtgaaaaactttgtgaaatatacggcgaatccggaagcggctaaattagttggcgccggtccaaaagcataa

SEQ ID NO: 214 - protein, 538 aa, Actinobacillus succinogenes
MTDLNKLVKELNDLGLTDVKEIVYNPSYEQLFEEETKPGLEGFDKGTLTTLGAVAVDTGIFTGRSPKDKYIVCDETTKDTVWWNSEAAKNDNKPMTQETWKSLRELVAKQLSGKRLFVVEGYCGASEKHRIGVRMVTEVAWQAHFVKNMFIRPTDEELKNFKADFTVLNGAKCTNPNWKEQGLNSENFVAFNITEGIQLIGGTWYGGEMKKGMFSMMNYFLPLKGVASMHCSANVGKDGDVAIFFGLSGTGKTTLSTDPKRQLIGDDEHGWDESGVFNFEGGCYAKTINLSQENEPDIYGAIRRDALLENVVVRADGSVDFDDGSKTENTRVSYPIYHIDNIVRPVSKAGHATKVIFLTADAFGVLPPVSKLTPEQTEYYFLSGFTAKLAGTERGVTEPTPTFSACFGAAFLSLHPIQYADVLVERMKASGAEAYLVNTGWNGTGKRISIKDTRGIIDAILDGSIEKAEMGELPIFNLAIPKALPGVDPAILDPRDTYADKAQWQVKAEDLANRFVKNFVKYTANPEAAKLVGAGPKA

SEQ ID NO: 215 - DNA, 52 bp, Artificial Sequence
  primer
cggataacaatttcacacaaggagactgccatgactgacttaaacaaactcg

SEQ ID NO: 216 - DNA, 91 bp, Artificial Sequence
  primer
tatcactgcgaagatctatcacggcatatccttgttctgattcagggtgatagcattgttatctcagccttatttttcagattttattcgg

SEQ ID NO: 217 - DNA, 89 bp, Artificial Sequence
  primer
acgtaacctgtagtttcatctaagcttgatagcgttatcacaaaaaggagatggaaaacctgaagcctgcttttttatactaagttggc

SEQ ID NO: 218 - DNA, 52 bp, Artificial Sequence
  primer
cgagtttgtttaagtcagtcatggcagtctccttgtgtgaaattgttatccg

SEQ ID NO: 219 - DNA, 22 bp, Artificial Sequence
  primer
gtcgattagcttatgtagaccg

SEQ ID NO: 220 - DNA, 21 bp, Artificial Sequence
  primer
tggagttcattgacggttggg

SEQ ID NO: 221 - DNA, 80 bp, Artificial Sequence
  primer
ggccgacagatgagttatgagcgcttttaatctcattacggagtttctgctgaagcctgcttttttatactaagttggca

SEQ ID NO: 222 - DNA, 80 bp, Artificial Sequence
  primer
ttatccttgctgaatcgaagcagcagcaagatgattctgaagttcaggaacgctcaagttagtataaaaaagctgaacga

SEQ ID NO: 223 - DNA, 30 bp, Artificial Sequence
  primer
attacactgttcccggtttgtccgtcggat

SEQ ID NO: 224 - DNA, 30 bp, Artificial Sequence
  primer
atagctgccgcagatgacaatgcttttatc

SEQ ID NO: 225 - DNA, 80 bp, Artificial Sequence
  primer
ctaccctatgtataagcctgatctacaggcatatttagcaaggatttcaatgaagcctgcttttttatactaagttggca

SEQ ID NO: 226 - DNA, 80 bp, Artificial Sequence
  primer
gagctggcaataagtccggacgggtatttaccgcagtccggacttattttcgctcaagttagtataaaaaagctgaacga

SEQ ID NO: 227 - DNA, 30 bp, Artificial Sequence
  primer
aacatcttatttgagattattaatatatta

SEQ ID NO: 228 - DNA, 30 bp, Artificial Sequence
  primer
ggaattggctggcgcttcgtctattttagg

SEQ ID NO: 229 - DNA, 945 bp, Corynebacterium glutamicum
  CDS (1)..(945)
atgaaagaaaccgtcggtaacaagattgtcctcattggcgcaggagatgttggagttgcatacgcatacgcactgatcaaccagggcatggcagatcaccttgcgatcatcgacatcgatgaaaagaaactcgaaggcaacgtcatggacttaaaccatggtgttgtgtgggccgattcccgcacccgcgtcaccaagggcacctacgctgactgcgaagacgcagccatggttgtcatttgtgccggcgcagcccaaaagccaggcgagacccgcctccagctggtggacaaaaacgtcaagattatgaaatccatcgtcggcgatgtcatggacagcggattcgacggcatcttcctcgtggcgtccaacccagtggatatcctgacctacgcagtgtggaaattctccggcttggaatggaaccgcgtgatcggctccggaactgtcctggactccgctcgattccgctacatgctgggcgaactctacgaagtggcaccaagctccgtccacgcctacatcatcggcgaacacggcgacactgaacttccagtcctgtcctccgcgaccatcgcaggcgtatcgcttagccgaatgctggacaaagacccagagcttgagggccgtctagagaaaattttcgaagacacccgcgacgctgcctatcacattatcgacgccaagggctccacttcctacggcatcggcatgggtcttgctcgcatcacccgcgcaatcctgcagaaccaagacgttgcagtcccagtctctgcactgctccacggtgaatacggtgaggaagacatctacatcggcaccccagctgtggtgaaccgccgaggcatccgccgcgttgtcgaactagaaatcaccgaccacgagatggaacgcttcaagcattccgcaaataccctgcgcgaaattcagaagcagttcttctaa

SEQ ID NO: 230 - protein, 314 aa, Corynebacterium glutamicum
MKETVGNKIVLIGAGDVGVAYAYALINQGMADHLAIIDIDEKKLEGNVMDLNHGVVWADSRTRVTKGTYADCEDAAMVVICAGAAQKPGETRLQLVDKNVKIMKSIVGDVMDSGFDGIFLVASNPVDILTYAVWKFSGLEWNRVIGSGTVLDSARFRYMLGELYEVAPSSVHAYIIGEHGDTELPVLSSATIAGVSLSRMLDKDPELEGRLEKIFEDTRDAAYHIIDAKGSTSYGIGMGLARITRAILQNQDVAVPVSALLHGEYGEEDIYIGTPAVVNRRGIRRVVELEITDHEMERFKHSANTLREIQKQFF

SEQ ID NO: 231 - DNA, 957 bp, Corynebacterium glutamicum
  CDS (1)..(957)
gtgggatcgaaaatgaaagaaaccgtcggtaacaagattgtcctcattggcgcaggcgatgtcggagttgcatacgcatatgcactgatcaaccaaggcatggcagaccaccttgcgatcatcgacattgatgaaaagaaactcgaaggcaacgtcaaggacttaaaccatggtgttgtgtgggccgattcccgcacccgcgtcactaagggaacctacgctgactgcgaagacgcagccatggttgtcatttgtgccggcgcagcccaaaagccaggcgagacccgcctccagctggtggacaaaaacgtcaagattatgaaatccatcgtcggcgatgtcatggacagcggattcgacggcatcttcctcgtggcgtccaacccagtggatatcctgacctacgcagtgtggaaattctccggcttggaatggaaccgcgtgatcggctccggaactgtcctggactccgctagattccgctacatgctcggcgaactctatgaagtggcaccaagctccgtccacgcctacatcatcggcgaacacggagacaccgaacttccagtcctgtcctccgcgaccatcgccggcgtatcgcttagccgaatgctggacaaagacccagagcttgagggccgtctagagaaaattttcgaagacacccgcgacgctgcctatcacattatcgacgccaagggctccacttcctacggcatcggcatgggtcttgctcgcatcacccgcgcaatcctacaaaaccaagacgttgcagtcccagtctctgcactgctccacggtgaatacggtgaggaagacatctacatcggcaccccagctgtggtgaaccgccgaggcatccgccgcgttgtcgaactagaaatcaccgaccacgagatggaacgcttcaagcattccgcaaataccctgcgcgaaattcagaagcagttcttctaa

SEQ ID NO: 232 - protein, 318 aa, Corynebacterium glutamicum
MGSKMKETVGNKIVLIGAGDVGVAYAYALINQGMADHLAIIDIDEKKLEGNVKDLNHGVVWADSRTRVTKGTYADCEDAAMVVICAGAAQKPGETRLQLVDKNVKIMKSIVGDVMDSGFDGIFLVASNPVDILTYAVWKFSGLEWNRVIGSGTVLDSARFRYMLGELYEVAPSSVHAYIIGEHGDTELPVLSSATIAGVSLSRMLDKDPELEGRLEKIFEDTRDAAYHIIDAKGSTSYGIGMGLARITRAILQNQDVAVPVSALLHGEYGEEDIYIGTPAVVNRRGIRRVVELEITDHEMERFKHSANTLREIQKQFF

SEQ ID NO: 233 - DNA, 1107 bp, Corynebacterium glutamicum
  CDS (1)..(1107)
atgagcactgtagtgcctggaattgtcgcactgtccaagggtgcaccggtagaaaaagtaaacgttgttgtccctgatccaggtgctaacgatgtcatcgtcaagattcaggcctgcggtgtgtgccacaccgacttggcctaccgcgatggcgatatttcagatgagttcccttacctcctcggccacgaggcagcaggcattgttgaggaggtaggcgagtccgtcacccacgttgaggtcggcgatttcgtcatcttgaactggcgtgcagtgtgcggcgagtgccgtgcatgtaagaagggcgagccaaagtactgctttaacacccacaacgcctctaagaagatgaccctggaagacggcaccgagctgtccccagcactgggtattggcgcgttcttggaaaagaccctggtccacgaaggccagtgcaccaaggttaaccctgaggaagatccagcagcagctggccttctgggttgtggcatcatggcaggccttggcgctgcggtgaacaccggtgatattaagcgtggcgagtccgtagcagtcttcggccttggtggcgtgggcatggcagctattgctggcgccaagattgctggcgcttccaagatcattgctgttgatatcgatgagaagaagctggagtgggcgaaggaattcggcgcaacccacaccattaattcctctggtcttggtggcgaaggtgatgcctctgaggtcgtggcaaaggttcgtgagctcaccgatggtttcggcaccgatgtctccatcgatgcggtaggcatcatgccgacctggcagcaggcgttttactcccgtgaccatgcaggccgcatggtgatggtgggcgttccaaacctgacgtctcgcgtagatgttcctgcgattgatttttacggtcgcggtggatccgtgcgccctgcatggtacggcgactgcctgcctgagcgtgatttcccaacttatgtggatctgcacctgcagggtcgtttcccactggataagtttgtttctgagcgtattggtcttgatgatgttgaagaggctttcaacaccatgaaggctggcgacgtgctgcgttctgtggtggagatctaa

SEQ ID NO: 234 - protein, 368 aa, Corynebacterium glutamicum
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 235 - DNA, 1689 bp, Escherichia coli
  CDS (1)..(1689)
atggcaagttcgggcacaacatcgacgcgtaagcgctttaccggcgcagaatttatcgttcatttcctggaacagcagggcattaagattgtgacaggcattccgggcggttctatcctgcctgtttacgatgccttaagccaaagcacgcaaatccgccatattctggcccgtcatgaacagggcgcgggctttatcgctcagggaatggcgcgcaccgacggtaaaccggcggtctgtatggcctgtagcggaccgggtgcgactaacctggtgaccgccattgccgatgcgcggctggactccatcccgctgatttgcatcactggtcaggttcccgcctcgatgatcggcaccgacgccttccaggaagtggacacctacggcatctctatccccatcaccaaacacaactatctggtcagacatatcgaagaactcccgcaggtcatgagcgatgccttccgcattgcgcaatcaggccgcccaggcccggtgtggatagacattcctaaggatgtgcaaacggcagtttttgagattgaaacacagcccgctatggcagaaaaagccgccgcccccgcctttagcgaagaaagcattcgtgacgcagcggcgatgattaacgctgccaaacgcccggtgctttatctgggcggcggtgtgatcaatgcgcccgcacgggtgcgtgaactggcggagaaagcgcaactgcctaccaccatgactttaatggcgctgggcatgttgccaaaagcgcatccgttgtcgctgggtatgctggggatgcacggcgtgcgcagcaccaactatattttgcaggaggcggatttgttgatagtgctcggtgcgcgttttgatgaccgggcgattggcaaaaccgagcagttctgtccgaatgccaaaatcattcatgtcgatatcgaccgtgcagagctgggtaaaatcaagcagccgcacgtggcgattcaggcggatgttgatgacgtgctggcgcagttgatcccgctggtggaagcgcaaccgcgtgcagagtggcaccagttggtagcggatttgcagcgtgagtttccgtgtccaatcccgaaagcgtgcgatccgttaagccattacggcctgatcaacgccgttgccgcctgtgtcgatgacaatgcaattatcaccaccgacgttggtcagcatcagatgtggaccgcgcaagcttatccgctcaatcgcccacgccagtggctgacctccggtgggctgggcacgatgggttttggcctgcctgcggcgattggcgctgcgctggcgaacccggatcgcaaagtgttgtgtttctccggcgacggcagcctgatgatgaatattcaggagatggcgaccgccagtgaaaatcagctggatgtcaaaatcattctgatgaacaacgaagcgctggggctggtgcatcagcaacagagtctgttctacgagcaaggcgtttttgccgccacctatccgggcaaaatcaactttatgcagattgccgccggattcggcctcgaaacctgtgatttgaataacgaagccgatccgcaggcttcattgcaggaaatcatcaatcgccctggcccggcgctgatccatgtgcgcattgatgccgaagaaaaagtttacccgatggtgccgccaggtgcggcgaatactgaaatggtgggggaataa

SEQ ID NO: 236 - protein, 562 aa, Escherichia coli
MASSGTTSTRKRFTGAEFIVHFLEQQGIKIVTGIPGGSILPVYDALSQSTQIRHILARHEQGAGFIAQGMARTDGKPAVCMACSGPGATNLVTAIADARLDSIPLICITGQVPASMIGTDAFQEVDTYGISIPITKHNYLVRHIEELPQVMSDAFRIAQSGRPGPVWIDIPKDVQTAVFEIETQPAMAEKAAAPAFSEESIRDAAAMINAAKRPVLYLGGGVINAPARVRELAEKAQLPTTMTLMALGMLPKAHPLSLGMLGMHGVRSTNYILQEADLLIVLGARFDDRAIGKTEQFCPNAKIIHVDIDRAELGKIKQPHVAIQADVDDVLAQLIPLVEAQPRAEWHQLVADLQREFPCPIPKACDPLSHYGLINAVAACVDDNAIITTDVGQHQMWTAQAYPLNRPRQWLTSGGLGTMGFGLPAAIGAALANPDRKVLCFSGDGSLMMNIQEMATASENQLDVKIILMNNEALGLVHQQQSLFYEQGVFAATYPGKINFMQIAAGFGLETCDLNNEADPQASLQEIINRPGPALIHVRIDAEEKVYPMVPPGAANTEMVGE

SEQ ID NO: 237 - DNA, 1725 bp, Escherichia coli
  CDS (1)..(1725)
atggagatgttgtctggagccgagatggtcgtccgatcgcttatcgatcagggcgttaaacaagtattcggttatcccggaggcgcagtccttgatatttatgatgcattgcataccgtgggtggtattgatcatgtattagttcgtcatgagcaggcggcggtgcatatggccgatggcctggcgcgcgcgaccggggaagtcggcgtcgtgctggtaacgtcgggtccaggggcgaccaatgcgattactggcatcgccaccgcttatatggattccattccattagttgtcctttccgggcaggtagcgacctcgttgataggttacgatgcctttcaggagtgcgacatggtggggatttcgcgaccggtggttaaacacagttttctggttaagcaaacggaagacattccgcaggtgctgaaaaaggctttctggctggcggcaagtggtcgcccaggaccagtagtcgttgatttaccgaaagatattcttaatccggcgaacaaattaccctatgtctggccggagtcggtcagtatgcgttcttacaatcccactactaccggacataaagggcaaattaagcgtgctctgcaaacgctggtagcggcaaaaaaaccggttgtctacgtaggcggtggggcaatcacggcgggctgccatcagcagttgaaagaaacggtggaggcgttgaatctgcccgttgtttgctcattgatggggctgggggcgtttccggcaacgcatcgtcaggcactgggcatgctgggaatgcacggtacctacgaagccaatatgacgatgcataacgcggatgtgattttcgccgtcggggtacgatttgatgaccgaacgacgaacaatctggcaaagtactgcccaaatgccactgttctgcatatcgatattgatcctacttccatttctaaaaccgtgactgcggatatcccgattgtgggggatgctcgccaggtcctcgaacaaatgcttgaactcttgtcgcaagaatccgcccatcaaccactggatgagatccgcgactggtggcagcaaattgaacagtggcgcgctcgtcagtgcctgaaatatgacactcacagtgaaaagattaaaccgcaggcggtgatcgagactctttggcggttgacgaagggagacgcttacgtgacgtccgatgtcgggcagcaccagatgtttgctgcactttattatccattcgacaaaccgcgtcgctggatcaattccggtggcctcggcacgatgggttttggtttacctgcggcactgggcgtcaaaatggcgttgccagaagaaaccgtggtttgcgtcactggcgacggcagtattcagatgaacatccaggaactgtctaccgcgttgcaatacgagttgcccgtactggtggtgaatctcaataaccgctatctggggatggtgaagcagtggcaggacatgatctattccggccgtcattcacaatcttatatgcaatcgctacccgatttcgtccgtctggcggaagcctatgggcatgtcgggatccagatttctcatccgcatgagctggaaagcaaacttagcgaggcgctggaacaggtgcgcaataatcgcctggtgtttgttgatgttaccgtcgatggcagcgagcacgtctacccgatgcagattcgcgggggcggaatggatgaaatgtggttaagcaaaacggagagaacctga

SEQ ID NO: 238 - protein, 574 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQTLVAAKKPVVYVGGGAITAGCHQQLKETVEALNLPVVCSLMGLGAFPATHRQALGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGTMGFGLPAALGVKMALPEETVVCVTGDGSIQMNIQELSTALQYELPVLVVNLNNRYLGMVKQWQDMIYSGRHSQSYMQSLPDFVRLAEAYGHVGIQISHPHELESKLSEALEQVRNNRLVFVDVTVDGSEHVYPMQIRGGGMDEMWLSKTERT

SEQ ID NO: 239 - DNA, 1647 bp, Pantoea ananatis
  CDS (1)..(1647)
atgacaggtgcacaatgggtagttcaggctttacgcgcacagggcgttgatatcgtatttggctatcctggtggcgcgatcatgccagtatacgatgcgctatacgacggcggcgtagaacacctgttgtgccgtcatgagcagggcgcggtaatggccgcaatcggctatgcccgttcaaccggcaaaaccggcgtttgcatcgcaacctctggccccggcgcgacgaatctgatcaccggtcttgccgacgccatgatggactctgttccggtcgtcgccttaaccgggcaggtcgcctctgcgttcatcggcacggatgcattccaggaaatcgatgttcttggcctgtcattagcctgcacgaaacacagctttatggttgagtctctggacgagttgccttccgtcatggccgaagccttcgctattgcccagtcaggccgccccggtcctgtattagtggatatcccgaaagatatccagatggcaaaaggcgagccttcgccgcagttgatgccggtcgaagaagtgatgtcgatgccgcaccaggccattgttgaagcgcgcgccatgatggctcaggctaaaaagccgatattctatgtgggcggcggtgtagggatggcgcaggccgtgccggcgctgcgcgcgctgatgcaggagaccggcatccctgctgtcgccacgctgaaaggcctgggaagtgttgacgcccacagcgaaggctatctgggcatgctgggcatgcacggtactaaggccgcaaaccttgccgtgcagtcctgtgacctgttgattgccgttggcgcgcgttttgacgaccgcgtcaccggtaaactggatacgtttgccccgttggccagcgtgattcatctggatgttgatcccgcagaactgaacaagttgcgccgtgcgcatgtttcactgcagggcgatcttaaccatgtcctgccagccttgagccagcctttacagattcagacatggcgtgacgaagtcgccgccctgaaagcccagcatgcatggcgctacgatcatcccggcgaagcgatctatgcgccgttattattgaaacaactgtccgaccgcaagcctgctaacaccgtgatcacgaccgacgtcggccagcaccagatgtgggcggcccagcatatctcctgtgacgcgcctgaagatttcatcacctccagcggattaggcaccatgggctttgggctgcccgcggcgatcggtgcgcaggttgcgcgtcccaacgatacggttatctgcgtctcgggcgatggctcgatcatgatgaacattcaggagctgggcaccatcaagcgtggcaagctgcctgtaaaaattctgctgctggacaaccagcgtttaggcatggtgcgccagtggcagcaactgttttttgatggtcgctacagtgaaaccatcctgactgataatcccgacttccttacgctggccagcgcgtttgatatcccaggccagcgcatcacccgtaaagatcaggtcgacgccgcactcgatgctctgctgagcagtgaaggaccttacttcctgcatgtttcaatcgatgagcatgaaaacgtctggccattggtaccgcctggtgccagcaacgccaacatgatggagaaaaccgtatga

SEQ ID NO: 240 - protein, 548 aa, Pantoea ananatis
MTGAQWVVQALRAQGVDIVFGYPGGAIMPVYDALYDGGVEHLLCRHEQGAVMAAIGYARSTGKTGVCIATSGPGATNLITGLADAMMDSVPVVALTGQVASAFIGTDAFQEIDVLGLSLACTKHSFMVESLDELPSVMAEAFAIAQSGRPGPVLVDIPKDIQMAKGEPSPQLMPVEEVMSMPHQAIVEARAMMAQAKKPIFYVGGGVGMAQAVPALRALMQETGIPAVATLKGLGSVDAHSEGYLGMLGMHGTKAANLAVQSCDLLIAVGARFDDRVTGKLDTFAPLASVIHLDVDPAELNKLRRAHVSLQGDLNHVLPALSQPLQIQTWRDEVAALKAQHAWRYDHPGEAIYAPLLLKQLSDRKPANTVITTDVGQHQMWAAQHISCDAPEDFITSSGLGTMGFGLPAAIGAQVARPNDTVICVSGDGSIMMNIQELGTIKRGKLPVKILLLDNQRLGMVRQWQQLFFDGRYSETILTDNPDFLTLASAFDIPGQRITRKDQVDAALDALLSSEGPYFLHVSIDEHENVWPLVPPGASNANMMEKTV

SEQ ID NO: 241 - DNA, 1785 bp, Pantoea ananatis
  CDS (1)..(1785)
atgtggctagcgggaaagcagtcgtcagtagattcagttcctcaagccgggaggcagaaaatggagatgttgtcaggagccgaaatggtcgtccggtcgttaatcgatcagggcgttaagcaggtattcggttatccgggtggcgcagtgctcgacatttacgatgcgctgcagaccgtcggcggtattgatcacgttctggttcgtcacgagcagggcgccgtgcatatggccgatggcctggctcgcgcaaccggcgaagtgggcgtggtgctggtaacgtcgggtccgggcgcaaccaatgcgatcaccggtattgcgacggcctatatggattctattccgttggttattctgtcaggtcaggtgccttcatccctgatcggctacgacgccttccaggaatgtgacatggtcggtatttcccgtccggtggtgaaacatagtttcctggtgaaaaataccgaagagatcccgacggtactgaaaaaagccttctggctggcatccacggggcgtcctggacctgtagttatcgatctgccaaaagatattctcaatcctgccaataagctgccttatcattatccgcaggaagtgagcatgcgctcctataatccgacgattcaggggcataagggccagatcaagcgtgcgttaaacacgttgctggcagcgcataagccggtgatctacgccggaggcggcgcgattacctcttcgtgcgaagccgaactgctgcagctggccgagcgcctgaatattccggttaccacgtcattgatggggctgggcgcgtttcccggcagtcatcgtcagtgcgtaggcatgcttggcatgcatggcacctacgaagcaaatatgaccatgcacaatgccgatttgatcttcggggtgggcgtccgttttgatgaccgcaccacgaacaatctggcgaagtattgcccgaacgctaccgtgatgcacatcgatatcgatcctacttccatttcaaaaacggtggcggccgatattccgatcgttggggatgccaaacagacgttacagcaaatgctcgaactgcttgaccaaagcgaagcgaagcagcaactggacagtctgcgcgactggtggcagtcgattgaaacctggcgtggtcgtcaatgcctcgaatacgatcgctccagcgacaaaatcaaaccgcaggcggttatcgaaaccatttgtcgtctcaccaacggggaggcctatgtgacctcggatgtgggtcagcatcagatgttcgccgccctctattacaccttcgataaaccccgtcgctggatcaactccggtggtctcggcaccatgggctttggcctgcctgccgcactgggggtgaaaatggccctgcctgacgaaaccgtcatctgcgttacgggcgatggcagtattcagatgaacatccaggagctctctaccgcactgcagtacgatttgccggtgttggtgctgaacctgaataaccgtttcctgggcatggtgaagcagtggcaggatatgatctattctggccgccactctcaatcctatatggaatcgctgcctgattttgttcgtctggcagaagcctatggccacgtgggtattgccattaatcatcccgctgagctggaagagaagctggccatggcgctggaaaccctggcgacaggacggctggtttttgttgacgtcaacgttgacggcagcgagcatgtttacccgatgcagattcgcggtggcagtatggacgaaatgtggttgagcaaaacggagaggacataa

SEQ ID NO: 242 - protein, 594 aa, Pantoea ananatis
MWLAGKQSSVDSVPQAGRQKMEMLSGAEMVVRSLIDQGVKQVFGYPGGAVLDIYDALQTVGGIDHVLVRHEQGAVHMADGLARATGEVGVVLVTSGPGATNAITGIATAYMDSIPLVILSGQVPSSLIGYDAFQECDMVGISRPVVKHSFLVKNTEEIPTVLKKAFWLASTGRPGPVVIDLPKDILNPANKLPYHYPQEVSMRSYNPTIQGHKGQIKRALNTLLAAHKPVIYAGGGAITSSCEAELLQLAERLNIPVTTSLMGLGAFPGSHRQCVGMLGMHGTYEANMTMHNADLIFGVGVRFDDRTTNNLAKYCPNATVMHIDIDPTSISKTVAADIPIVGDAKQTLQQMLELLDQSEAKQQLDSLRDWWQSIETWRGRQCLEYDRSSDKIKPQAVIETICRLTNGEAYVTSDVGQHQMFAALYYTFDKPRRWINSGGLGTMGFGLPAALGVKMALPDETVICVTGDGSIQMNIQELSTALQYDLPVLVLNLNNRFLGMVKQWQDMIYSGRHSQSYMESLPDFVRLAEAYGHVGIAINHPAELEEKLAMALETLATGRLVFVDVNVDGSEHVYPMQIRGGSMDEMWLSKTERT

SEQ ID NO: 243 - DNA, 1881 bp, Corynebacterium glutamicum
  CDS (1)..(1881)
gtgaatgtggcagcttctcaacagcccactcccgccacggttgcaagccgtggtcgatccgccgcccctgagcggatgacaggtgcaaaggcaattgttcgatcgctcgaggagcttaacgccgacatcgtgttcggtattcctggtggtgcggtgctaccggtgtatgacccgctctattcctccacaaaggtgcgccacgtcttggtgcgccacgagcagggcgcaggccacgcagcaaccggctacgcgcaggttactggacgcgttggcgtctgcattgcaacctctggcccaggagcaaccaacttggttaccccaatcgctgatgcaaacttggactccgttcccatggttgccatcaccggccaggtcggaagtggcctgctgggtaccgacgctttccaggaagccgatatccgcggcatcaccatgccagtgaccaagcacaacttcatggtcaccaaccctaacgacattccacaggcattggctgaggcattccacctcgcgattactggtcgccctggccctgttctggtggatattcctaaggatgtccagaacgctgaattggatttcgtctggccaccaaagatcgacctgccaggctaccgcccagtttcaacaccacatgctcgccagatcgagcaggcagtcaagctgatcggtgaggccaagaagcccgtcctttacgttggtggtggcgtaatcaaggctgacgcacacgaagagcttcgtgcgttcgctgagtacaccggcatcccagttgtcaccaccttgatggctttgggtactttcccagagtctcacgagctgcacatgggtatgccaggcatgcatggcactgtgtccgctgttggtgcactgcagcgcagcgacctgctgattgctatcggctcccgctttgatgaccgcgtcaccggtgacgttgacaccttcgcgcctgacgccaagatcattcacgccgacattgatcctgccgaaatcggcaagatcaagcaggttgaggttccaatcgtgggcgatgcccgcgaagttcttgctcgtctgctggaaaccaccaaggcaagcaaggcagagaccgaggacatctccgagtgggttgactacctcaagggcctcaaggcacgtttcccgcgtggctacgacgagcagccaggcgatctgctggcaccacagtttgtcattgaaaccctgtccaaggaagttggccccgacgcaatttactgcgccggcgttggccagcaccaaatgtgggcagctcagttcgttgactttgaaaagccacgcacctggctcaactccggtggactgggcaccatgggctacgcagttcctgcggcccttggagcaaaggctggcgcacctgacaaggaagtctgggctatcgacggcgacggctgtttccagatgaccaaccaggaactcaccaccgccgcagttgaaggtttccccattaagatcgcactaatcaacaacggaaacctgggcatggttcgccaatggcagaccctattctatgaaggacggtactcaaatactaaacttcgtaaccagggcgagtacatgcccgactttgttaccctttctgagggacttggctgtgttgccatccgcgtcaccaaagcggaggaagtactgccagccatccaaaaggctcgagagatcaacgaccgcccagtagtcatcgacttcatcgtcggtgaagacgcacaggtatggccaatggtgtctgctggatcatccaactccgatatccagtacgcactcggattgcgcccattctttgatggtgatgaatctgcagcagaagatcctgccgacattcacgaagccgtcagcgacattgatgccgccgttgaatcgaccgaggcataa

SEQ ID NO: 244 - protein, 626 aa, Corynebacterium glutamicum
MNVAASQQPTPATVASRGRSAAPERMTGAKAIVRSLEELNADIVFGIPGGAVLPVYDPLYSSTKVRHVLVRHEQGAGHAATGYAQVTGRVGVCIATSGPGATNLVTPIADANLDSVPMVAITGQVGSGLLGTDAFQEADIRGITMPVTKHNFMVTNPNDIPQALAEAFHLAITGRPGPVLVDIPKDVQNAELDFVWPPKIDLPGYRPVSTPHARQIEQAVKLIGEAKKPVLYVGGGVIKADAHEELRAFAEYTGIPVVTTLMALGTFPESHELHMGMPGMHGTVSAVGALQRSDLLIAIGSRFDDRVTGDVDTFAPDAKIIHADIDPAEIGKIKQVEVPIVGDAREVLARLLETTKASKAETEDISEWVDYLKGLKARFPRGYDEQPGDLLAPQFVIETLSKEVGPDAIYCAGVGQHQMWAAQFVDFEKPRTWLNSGGLGTMGYAVPAALGAKAGAPDKEVWAIDGDGCFQMTNQELTTAAVEGFPIKIALINNGNLGMVRQWQTLFYEGRYSNTKLRNQGEYMPDFVTLSEGLGCVAIRVTKAEEVLPAIQKAREINDRPVVIDFIVGEDAQVWPMVSAGSSNSDIQYALGLRPFFDGDESAAEDPADIHEAVSDIDAAVESTEA

SEQ ID NO: 245 - DNA, 783 bp, Pantoea ananatis
  CDS (1)..(783)
atgagcaattttgtaactgattgttcctgcgaggatcaactaaaagataccgtccaaaagctgcgaaaaaacatgccagaaagtgttatgtatcaaacctctttgatgagtgcgctgctgagtggtgtttatgacggtgaaaccaggattgctgacttactgcgcaaaggtgactttggtctgggaaccttcaatcagctggatggtgaactcattgcgttcgacagcaatgtgtatcagctgcgcgccgatggcagtgcccggcctgctgatcctgaccagaaaacgccatttgcggtaatgaccttttttcaaccccagcataaacacgtttttgaacgcgcggttcagcgcgatgcgctgcaccagcttatcgacagcgaaatcacctccgacaaccagttttgtgcactgcgtgtaagcggacatttttcatccgtccagacgcgtaccgttccgtgccagtgccggccttaccgatcgatgcctgaagttctgggaaaccagcccatatttgaattcacgcatcgccatggcgagcttattggcttccgcacgccgcagtacatgcagggtatcaacgtcgcaggatatcacgaacatttcatcacagacgacagaaccggcggtgggcatatcctggattatgtgctggagcagggcacgctgacttttggtgccatcagcaagctggtgatcgatttacctgaaaacgccgactttcttaatgccaacctgacgccggaaaacctggatgatgccatccgttctgtcgaaagctaa

SEQ ID NO: 246 - protein, 260 aa, Pantoea ananatis
MSNFVTDCSCEDQLKDTVQKLRKNMPESVMYQTSLMSALLSGVYDGETRIADLLRKGDFGLGTFNQLDGELIAFDSNVYQLRADGSARPADPDQKTPFAVMTFFQPQHKHVFERAVQRDALHQLIDSEITSDNQFCALRVSGHFSSVQTRTVPCQCRPYRSMPEVLGNQPIFEFTHRHGELIGFRTPQYMQGINVAGYHEHFITDDRTGGGHILDYVLEQGTLTFGAISKLVIDLPENADFLNANLTPENLDDAIRSVES

SEQ ID NO: 247 - DNA, 768 bp, Pantoea ananatis
  CDS (1)..(768)
atgcgggttgcgcttgtgacaggtgcgggtcagggcattggtgaggcgatagccttacgtctggcaaaagacggatttgccgtggccgtggctgattacaatattgaaaccgcgtcgcaggttgcggaaaagatcaagaaagatggcggccgtgcgctggccatcaaggtggatgtaacaaaacgggatcaggtatttcatgccgttgaagaagcgcgcagcgtattgggtgattttaacgtcattgtgaataacgcaggtgtcgcgccctcaacgcccattgatgaaatcaccgaagaggtcatcaacaaggtttacgacgttaatgtcaaaggcgtgatctggggcatgcaggcagcaataaaagcgttcgcgtctgaaggtcatggcggaaaaattattaacgcctgttctcaggccgggcatgtcggcaatcccgagctggcagtttacagctcaagcaagtttgctgttcggggcctgacacaaactgccgcacgggatctggcaccggcggggatcaccgtgaatggcttttgtcctggtattgttaaaacaccgatgtgggcggagatcgacaggcagatttccgaagcggcaggcaaacccgtgggttatggtactcaggagtttgcgaaaagaatcacgcttggtcggttatcagaacccgaagatgtcgcagcctgtgtcgcctttcttgccggcccggattctgattacatcaccggacagtcgttactggtagacggtggcatggtgtttagctaa

SEQ ID NO: 248 - protein, 255 aa, Pantoea ananatis
MRVALVTGAGQGIGEAIALRLAKDGFAVAVADYNIETASQVAEKIKKDGGRALAIKVDVTKRDQVFHAVEEARSVLGDFNVIVNNAGVAPSTPIDEITEEVINKVYDVNVKGVIWGMQAAIKAFASEGHGGKIINACSQAGHVGNPELAVYSSSKFAVRGLTQTAARDLAPAGITVNGFCPGIVKTPMWAEIDRQISEAAGKPVGYGTQEFAKRITLGRLSEPEDVAACVAFLAGPDSDYITGQSLLVDGGMVFS

SEQ ID NO: 249 - DNA, 777 bp, Corynebacterium glutamicum
  CDS (1)..(777)
atgagcaaagttgcaatggttaccggtggtgcacaaggcatcggtcgtggaatttcagagaagctggcagcagatggtttcgatattgccgtagccgacctgccacaacaggaagaacaagctgcagagaccatcaagttgattgaagctgcaggtcaaaaggctgtattcgttggattagatgtcaccgataaggctaatttcgacagtgcaattgatgaggcagcagagaaacttggcggcttcgatgtgctagtaaacaacgccggcatcgcacaaattaagccacttctggaagtcaccgaagaagacctaaagcagatctactccgtgaacgtttttagcgtattttttggtattcaagcagcatcccgaaagttcgatgagcttggcgtaaaaggcaagatcatcaacgctgcatcaatcgctgctatccaaggtttcccaatcttgagcgcctactccaccaccaaattcgcggttcgtggcctcacccaggctgctgcgcaagaactcgcacccaagggtcacaccgtgaatgcctacgcacctggcatcgtgggcaccggaatgtgggagcaaatcgatgccgagctttccaagatcaacggcaagccaatcggtgagaacttcaaggagtactcctcctcaatcgcattgggccgaccatcagtacctgaggatgtagccggtctggtttcgttcctggcttctgaaaactccaactacatcaccggacaggtcatgcttgtcgacggcggcatgctctacaactag

SEQ ID NO: 250 - protein, 258 aa, Corynebacterium glutamicum
MSKVAMVTGGAQGIGRGISEKLAADGFDIAVADLPQQEEQAAETIKLIEAAGQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYITGQVMLVDGGMLYN

SEQ ID NO: 251 - DNA, 22 bp, Artificial Sequence
  primer
tggtttcgagcagacgagcaag

SEQ ID NO: 252 - DNA, 20 bp, Artificial Sequence
  primer
ttttcaaacagtgcgcgacg

SEQ ID NO: 253 - DNA, 20 bp, Artificial Sequence
  primer
tggtgtccttcaactaagcc

SEQ ID NO: 254 - DNA, 21 bp, Artificial Sequence
  primer
gctttgttcacaattgctgac

SEQ ID NO: 255 - DNA, 37 bp, Artificial Sequence
  primer
cggtacccggggatccagccctcttctaatgcatacc

SEQ ID NO: 256 - DNA, 36 bp, Artificial Sequence
  primer
tcgtattaattggcggagttcatcatgcgccaacag

SEQ ID NO: 257 - DNA, 20 bp, Artificial Sequence
  primer
cgccaattaatacgagtttg

SEQ ID NO: 258 - DNA, 36 bp, Artificial Sequence
  primer
ccaagcttgcatgcccatcacaccgatcagaagctg

SEQ ID NO: 259 - DNA, 20 bp, Artificial Sequence
  primer
cgcgtgccttctctagtgcc

SEQ ID NO: 260 - DNA, 61 bp, Artificial Sequence
  primer
agcgttgaagatgtgtgagtcgacattataatcctcctaacaggaatgttcctttcgaaaa

SEQ ID NO: 261 - DNA, 61 bp, Artificial Sequence
  primer
ttttcgaaaggaacattcctgttaggaggattataatgtcgactcacacatcttcaacgct

SEQ ID NO: 262 - DNA, 20 bp, Artificial Sequence
  primer
ccaaatccaactcacccatc

SEQ ID NO: 263 - DNA, 43 bp, Artificial Sequence
  primer
ccaagcttgcatgcctgcagatttgcgcctgcaacgtaggttg

SEQ ID NO: 264 - DNA, 39 bp, Artificial Sequence
  primer
cggtacccggggatccaagccccgcctcctccatgagga

SEQ ID NO: 265 - DNA, 2727 bp, Rhodococcus jostii
atgagcaccattgcattcatcggactcggaatcatgggcagccccatggccgttcatctcgccaaggccggccaccaggtggtcggatacaaccgctcgcccgagcgcaccgcggcgctcgtcgacgccgggggcaccgcggccgactccatcgccaaggccgttgccggcgccgacgtcgtggccgtgatggtccccgactccccggacgtccaggccgtactcgccggcgaggacggagtcttcgagcacgccccggccggcgccctgatcatcgacttctccagcatccggcccgacgtcaccaccgccctcgccgcgcaggcaaccgagcggggcttccggctgatcgacgccccggtatcgggtggcgaggccggtgcggtcaacgccgcactgtcgatcatggtcggcggcgcgccggaggatttcgaggcggccaagccgatcctcgacaccgtcggcaagaccgtggtgcacgtgggcccgaacggttccgggcagacggtgaaggccgcgaaccagctgatcgtcgcgggcaacatccaactcctcgccgaggcgatcatcttcctcgaggcctacggtgtcgacaccgcggctgcggtcgaggtgctcggcggcgggctggccggatcggccgtcctgaaccagaaggcacagaagatgctggaccggtccttcgaaccgggattccgcatcgaactgcaccacaaggacctcggcatcgtgaccagcgccgctcgcgaggccggtgtcgtgacacccctcggcgcggtcgtcgcccagctgatggcctccgcccgtgcgaacggtgatggtggcctggaccattcgggcctgctgcgtggagtggagcggctgtccggccgcccctcccagtgacccgttccaactcgtaatcctcgatggagaagtgatatgcctcgtatgcgcgccgctgacgcagcggtcaagattctggaactcgaaggtgccactcaggccttcggccttcccggtgcggcgatcaacccgttctacgcagcaatgcgtaaccacggaggaatcaagcacatcctcgcccgccacgtcgagggcgcctcccacatggccgagggattcacccgcgccaaggccggaaacatcggagtctgcatcggcacctccgggcccgccggaaccgacatgatcaccggtctgtattcggccatggcggactcgatcccgatcctcgcgatcaccggccaagctcccgtggcgcgcctgcacaaggaagacttccaggccgtcgacatcgcctcgatcgcaggcccggtcacgaagatggcgatgacggtgctcgagccggcccaggttccgggagcgttcgcgcaggcatttcacttgatgcggtctggtcggccaggaccggtgctcatcgacctgccgatcgacgtgcagttggcggagatcgacttcgacccggatacctaccagccgctgcccgtgtacaagccggccgcgacccgcgcgcaggcggagaaggcactcgacatgctgggtgccgccgaacgcccgctgatcgttgcgggcggtggcatcatcaacgccgacgccgcggacctgctggtggaactggccgaactgctggacattccggtcgtgccgacgctgatgggctggggcaccatcccggacgaccaccgtctcgccgccgggatggtcggactgcagaccgcccaccgatacggcaacgccacgatgctggcgtcggacttcgtcctcggcatcggcaaccggtgggccaaccggcacacgggcggtctcgacacctaccggaagggccgcaagttcgttcacgtcgacatcgaacccacccagatcggtcgcgtgttcgcgcccgactacgggatcgtgtccgacgccaaggctgcgctcgaactgttcgtcgccgtcgcgaaggagcgcaaggccgccggaaccctggcggaccgcagcacctgggtcgaggactgtgccacccggaagcggaccatgcagcgcaagacccacttcgacgacgtcccggtcaaaccgcagcgcgtgtacgaggagatgaaccgcgtcttcgggcgcgacacccggtacgtgagcacgatcgggctctcgcagatcgccggcggccagttcctgcacgtctacaaggcccgcaactggatcaactgcgggcaggccgggccgctcggctggacgatccccgccgctctcggagtggttgccgcggagccggagacgcccgtcgtggcgctgtccggtgactacgacttccagttcatgatcgaggaactggccgtgggcgcccagttcaacctgccgtacatccacgtcgtggtgaacaactcctacctgggactgatccgtcaggcacagcgcgcgttcgacatggacttctgcgtgcaactgggcttcgacaacatcaacacccaggagcggagcgagcacgagacgatgcccgcggtcccgaaggggtacggcgtcgatcacgtcaaggtcgccgagggcctgggctgcaaggccctgcgggtcaccgagccgggcgagatcgccggcgccctggagaaggcccgcgaactcgccggagaacacaaggtgccggtggtcgtcgaggtcttcctcgagcgggtcaccaacatcgcgatgggcaccgaactcgacaacgtcgccgagttcgaggatctggcggagagctgggagcacgctcccacagccctcatgctgctggactag

SEQ ID NO: 266 - DNA, 3344 bp, Methylococcus capsulatus
tctagatcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatcggctcgtataatgtgtggaattgtgagcggataacaatttcacacaggaaacagaattcacaaaaaggataaaacaatggctgtcaagaaccgtctacaccgcagcgaactcgcggtgccgggcagcaatccacgcatgctcgagaaagcgccggaagccggcgccgacatcgtctttctggacctggaagatgcggttgcgccggatgacaaggagcaagcgcgccggaacatcgtcttcgcgctcaacacctacgactggtccagatgcgcggtctccgtccgcatcaacggcctcgacacccattacgcctaccgggacctcgttgagatcgtcgagtcctgcggcgacaagctcgacaccattctggtgccgaaagtcggcagcgcctcggacgttctgttcgtcgcgactttactttcccagatcgaggcctacaaaggtttcaaaccgatcaatatccacgtgctgatcgaaacggccatgggcatggccaacgtggaggagatcgcccgcacctgtcctgaacgcatggaggccatggtgttcggcgtggccgactacgctgcgtcggtgcgcgcccgcacgaccaacatcggcggcgccaacccggattacggcatgctgaccgaccctgacgaaagcggtacccgcgcctatcactgggccgaccagtggcatttcggcatttcccgcatggtcgcggcctgccgcgcctatgggcttcgccccatcgacggccccttcggcgatttcagcgatccggaaggattccgcgccgcagcccgccgtgccgcggcactgggctgcgaagggaagtgggcgatccatccctcccagattccactgtgcaacgaaatcttcacacccacggaaaaagaggtcacgcgggcctaccgcatcctggaagccatggagcaggcggcaaaggagggcaaaggcgcggtgtctctggatgggcggctgatcgatgccgcctcgatccggatggcggagaacgtggtccgccagatgaagcagatcgagtcgcgtcggtaggaatcccccctgtctcgcgcgatgcatatttcgagttgaacgaggagatcgtccgtgaatatccatgagtaccaggccaaggagctgctcaagacctatggcgtgcccgtgcccgacggcgccgttgcctattccgacgcgcaggccgccagcgtcgccgaggagatcggcggcagccgctgggtggtcaaggcgcagatccatgccggcggtcgcggcaaggccgggggcgtaaaggtcgcccactccatcgaggaagtccgccaatacgccgacgccatgctcggcagccacctcgtcacccatcagaccggcccgggaggctcgctggttcagcgtctgtgggtggaacaggccagccatatcaaaaaggaatactacctgggcttcgtgatcgatcgcggcaatcaacgcatcaccctgatcgcctccagcgagggcggcatggaaatcgaggaagtcgcaaaggaaaccccggagaaaatcgtcaaggaagtcgtcgatccggccataggcctgctggacttccagtgccgcaaggtcgccacggcgatcggcctgaaaggcaaactgatgccccaggccgtcaggctgatgaaggccatctaccgctgcatgcgcgacaaagatgccctgcaggccgaaatcaatcctctggccatcgtgggcgaaagcgacgaatcgctcatggtcctggatgccaagttcaacttcgacgacaacgccctgtaccggcagcgcaccatcaccgagatgcgcgacctggccgaggaagacccgaaagaggtcgaagcctccggccacggtctcaattacatcgccctcgacggcaacatcggctgcatcgtcaatggcgccggcctcgccatggcttcgctcgacgccatcaccctgcatggcggccgtccggccaacttcctcgacgtgggcggcggcgcctcccccgagaaggtcaccaatgcctgccgcatcgtactggaagatcccaacgtccgctgcatcctggtcaacatctttgccggcatcaaccgctgtgactggatcgccaagggcctgatccaggcctgcgacagcctgcagatcaaggtgccgctgatcgtgcgcctggccgggacgaacgtcgacgagggccgcaagatcctggccgaatccggcctctccttcatcaccgcggaaaatctggacgacgcggccgccaaggccgtcgccatcgtcaagggataacagtcatgagcgtattcgttaacaagcactccaaggtcatcttccagggcttcaccggcgagcacgccaccttccacgccaaggacgccatgcggatgggcacccgggtggtcggcggtgtcacccctggcaaaggcggcacccgccatcccgatcccgaactcgctcatctgccggtgttcgacaccgtggctgaagccgtggccgccaccggcgccgacgtctccgccgtgttcgtgccgccgcccttcaatgcggacgcgttgatggaagccatagacgccggcatccgggtcgccgtgaccatcgccgacggcatcccggtacacgacatgatccgactgcagcgctaccgggtgggtaaggattccatcgtgatcggaccgaacacccccggcatcatcacgccgggcgagtgcaaggtgggcatcatgccttcgcacatttacaagaagggcaacgtcggcatcgtgtcgcgctccggcaccctcaattacgaggcgacggaacagatggccgcgcttgggctgggcatcaccacctcggtcggtatcggcggtgaccccatcaacggaaccgatttcgtcactgtcctgcgcgccttcgaagccgacccggaaaccgagatcgtggtgatgatcggcgaaatcggcggcccccaggaagtcgccgccgcccgctgggccaaggaaaacatgacaaagccggtcatcggcttcgtcgcaggccttgccgcaccgaccggccgacgcatgggccatgccggcgccatcatctccagcgaggccgacaccgccggagccaagatggacgccatggaagccttggggctgtatgtcgcccgcaacccggcacagatcggccagaccgtgctacgcgccgcgcaggaacacggaatcagattctgaggatcc

SEQ ID NO: 267 - DNA, 50 bp, Artificial Sequence
  primer
atgcggatccacaaaaaggataaaacaatgagcaccattgcattcatcgg

SEQ ID NO: 268 - DNA, 34 bp, Artificial Sequence
  primer
tcaaggtaccctagtccagcagcatgagggctgt

SEQ ID NO: 269 - DNA, 28 bp, Artificial Sequence
  primer
atggtctagatcaggcagccatcggaag

SEQ ID NO: 270 - DNA, 37 bp, Artificial Sequence
  primer
tttgtggatccgcattcagaatctgattccgtgttcc

SEQ ID NO: 271 - DNA, 39 bp, Artificial Sequence
  primer
actagggtaccttgagagctcgaattcactggccgtcgt

SEQ ID NO: 272 - DNA, 40 bp, Artificial Sequence
  primer
cctgatctagaccatgtcgacctgcaggcatgcaagcttg

SEQ ID NO: 273 - DNA, 1602 bp, Corynebacterium glutamicum
  CDS (1)..(1602)
atgattttaggcgtacccattcaatatttgctctattcattgtggaattggattgtcgataccggttttgatgtagcaattatcctggtcttggcgtttttgattccacgtatcggccgactggccatgcgtattatcaagcagcgagtggagtctgcagccgatgcggacaccactaagaaccagctcgcgttcgctggcgttggcgtttatatcgcgcaaattgtggcgtttttcatgcttgccgtctccgcgatgcaggcttttggtttctctctcgcgggcgctgcgattccggcaaccattgcgtcagctgccattggtcttggtgcgcagtcgattgttgcggacttcttggccggatttttcatcctgacggaaaagcaattcggcgtgggtgactgggtgcgctttgagggcaacggcatcgttgttgaaggcaccgtcattgagatcaccatgcgcgcgaccaaaattcgcacgattgcacaagagaccgtgatcatcccgaactccacggcgaaagtgtgcatcaacaattctaataactggtcgcgtgcggttgtcgttattccgatccccatgttgggttctgaaaacatcacagatgtcatcgcgcgctctgaagctgcgactcgtcgcgcacttggccaggagaaaatcgcaccggaaatcctcggtgaactcgatgtgcacccagccacggaagtcacaccgccaacggtggtcggcatgccgtggatggtcaccatgcgtttcctcgtgcaagtcaccgccggcaatcaatggctggtcgaacgcgccatccgcacagaaatcatcaacgaattctgggaagaatacggcagcgcaaccactacatcgggaaccctcattgattccttacacgttgagcatgaagagccaaagacctcgcttatcgacgcctccccccaggctcttaaggaaccgaagccggaggctgcggcgacggttgcatcgctagctgcatcgtctaacgacgatgcagacaatgcagacgcctcggcgatcaatgcaggcaatccagagaaggaacttgattccgatgtgctggaacaagaactctccagcgaagaaccggaagaaacagcaaaaccagatcactctctccgaggcttcttccgcactgattactacccaaatcggtggcagaagatcctgtcgtttggcggacgtgtccgcatgagcacttccctgttgttgggtgcgctgctcttgctgtcactatttaaggtcatgactgtggaaccaagtgagaattggcaaaactccagtggatggctgtcaccaagcactgccacctcaactgcggtgaccacctccgaaacttccgcgccagcaagcacgccttcgatgacagtgcccactacggtggaggagaccccaacgatggaatctagcgtcgaaacgcagcaggaaacctcaacccctgcaaccgcaacgccccagcgagccgacaccatcgaaccgaccgaggaagccacgtcgcaggaggaaacgactgcatcgcagacgcagtctccagcagtggaagcaccaaccgcggtccaagaaacagttgcgccgacgtccaccccttag

SEQ ID NO: 274 - protein, 533 aa, Corynebacterium glutamicum
MILGVPIQYLLYSLWNWIVDTGFDVAIILVLAFLIPRIGRLAMRIIKQRVESAADADTTKNQLAFAGVGVYIAQIVAFFMLAVSAMQAFGFSLAGAAIPATIASAAIGLGAQSIVADFLAGFFILTEKQFGVGDWVRFEGNGIVVEGTVIEITMRATKIRTIAQETVIIPNSTAKVCINNSNNWSRAVVVIPIPMLGSENITDVIARSEAATRRALGQEKIAPEILGELDVHPATEVTPPTVVGMPWMVTMRFLVQVTAGNQWLVERAIRTEIINEFWEEYGSATTTSGTLIDSLHVEHEEPKTSLIDASPQALKEPKPEAAATVASLAASSNDDADNADASAINAGNPEKELDSDVLEQELSSEEPEETAKPDHSLRGFFRTDYYPNRWQKILSFGGRVRMSTSLLLGALLLLSLFKVMTVEPSENWQNSSGWLSPSTATSTAVTTSETSAPASTPSMTVPTTVEETPTMESSVETQQETSTPATATPQRADTIEPTEEATSQEETTASQTQSPAVEAPTAVQETVAPTSTP

SEQ ID NO: 275 - DNA, 3474 bp, Corynebacterium glutamicum
gtgactgctatcacccttggcggtctcttgttgaaaggaataattactctagtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtactgaaggctcaccagtcaaggcgtacctggacatcgatgaaattatcggtgcagctaaaaaagttaaagcagatgctatttacccgggatatggcttcctgtctgaaaatgcccagcttgcccgcgagtgcgcggaaaacggcattacttttattggcccaaccccagaggttcttgatctcaccggtgataagtctcgtgcggtaaccgccgcgaagaaggctggtctgccagttttggcggaatccaccccgagcaaaaacatcgatgacatcgttaaaagcgctgaaggccagacttaccccatctttgtaaaggcagttgccggtggtggcggacgcggtatgcgctttgtttcttcacctgatgagctccgcaaattggcaacagaagcatctcgtgaagctgaagcggcattcggcgacggttcggtatatgtcgaacgtgctgtgattaacccccagcacattgaagtgcagatccttggcgatcgcactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgttttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggatttatcggcgatcacccacacctccttcaggctccacctgcggatgatgagcagggacgcatcctggattacttggcagatgtcaccgtgaacaagcctcatggtgtgcgtccaaaggatgttgcagcaccaatcgataagctgcccaacatcaaggatctgccactgccacgcggttcccgtgaccgcctgaagcagcttggcccagccgcgtttgctcgtgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggcgcgacctacgatgtggcgatgcgtttcctctttgaggatccgtgggacaggctcgacgagctgcgcgaggcgatgccgaatgtaaacattcagatgctgcttcgcggccgcaacaccgtgggatacaccccgtacccagactccgtctgccgcgcgtttgttaaggaagctgccacctccggcgtggacatcttccgcatcttcgacgcgcttaacgacgtctcccagatgcgtccagcaatcgacgcagtcctggagaccaacaccgcggtagccgaggtggctatggcttattctggtgatctctctgatccaaatgaaaagctctacaccctggattactacctaaagatggcagaggagatcgtcaagtctggcgctcacattctggccattaaggatatggctggtctgcttcgcccagctgcggtaaccaagctggtcaccgcactgcgccgtgaattcgatctgccagtgcacgtgcacacccacgacactgcgggtggccagttggctacctactttgctgcagctcaagctggtgcagatgctgttgacggtgcttccgcaccactgtctggcaccacctcccagccatccctgtctgccattgttgctgcattcgcgcacacccgtcgcgataccggtttgagcctcgaggctgtttctgacctcgagccgtactgggaagctgtgcgcggactgtacctgccatttgagtctggaaccccaggcccaaccggtcgcgtctaccgccacgaaatcccaggcggacagttgtccaacctgcgtgcacaggccaccgcactgggccttgctgatcgcttcgagctcatcgaagacaactacgcagccgttaatgagatgctgggacgcccaaccaaggtcaccccatcctccaaggttgttggcgacctcgcactccacctggttggtgcgggtgtagatccagcagactttgctgcagacccacaaaagtacgacatcccagactctgtcatcgcgttcctgcgcggcgagcttggtaaccctccaggtggctggccagaaccactgcgcacccgcgcactggaaggccgctccgaaggcaaggcacctctgacggaagttcctgaggaagagcaggcgcacctcgacgctgatgattccaaggaacgtcgcaacagcctcaaccgcctgctgttcccgaagccaaccgaagagttcctcgagcaccgtcgccgcttcggcaacacctctgcgctggatgatcgtgaattcttctacggactggtcgagggccgcgagactttgatccgcctgccagatgtgcgcaccccactgcttgttcgcctggatgcgatctctgagccagacgataagggtatgcgcaatgttgtggccaacgtcaacggccagatccgcccaatgcgtgtgcgtgaccgctccgttgagtctgtcaccgcaaccgcagaaaaggcagattcctccaacaagggccatgttgctgcaccattcgctggtgttgtcactgtgactgttgctgaaggtgatgaggtcaaggctggagatgcagtcgcaatcatcgaggctatgaagatggaagcaacaatcactgcttctgttgacggcaagattgaacgcgttgtggttcctgctgcaacgaaggtggaaggtggcgacttgatcgtcgtcgtttcctaa

SEQ ID NO: 276 - protein, 1157 aa, Corynebacterium glutamicum
MTAITLGGLLLKGIITLVSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDDIVKSAEGQTYPIFVKAVAGGGGRGMRFVSSPDELRKLATEASREAEAAFGDGSVYVERAVINPQHIEVQILGDRTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIGDHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAATSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIERVVVPAATKVEGGDLIVVVS

SEQ ID NO: 277 - DNA, 1620 bp, Corynebacterium glutamicum
gtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctag

SEQ ID NO: 278 - protein, 539 aa, Corynebacterium glutamicum
MSFLVENQLLALVVIMTVGLLLGRIKIFGFRLGVAAVLFVGLALSTIEPDISVPSLIYVVGLSLFVYTIGLEAGPGFFTSMKTTGLRNNALTLGAIIATTALAWALITVLNIDAASGAGMLTGALTNTPAMAAVVDALPSLIDDTGQLHLIAELPVVAYSLAYPLGVLIVILSIAIFSSVFKVDHNKEAEEAGVAVQELKGRRIRVTVADLPALENIPELLNLHVIVSRVERDGEQFIPLYGEHARIGDVLTVVGADEELNRAEKAIGELIDGDPYSNVELDYRRIFVSNTAVVGTPLSKLQPLFKDMLITRIRRGDTDLVASSDMTLQLGDRVRVVAPAEKLREATQLLGDSYKKLSDFNLLPLAAGLMIGVLVGMVEFPLPGGSSLKLGNAGGPLVVALLLGMINRTGKFVWQIPYGANLALRQLGITLFLAAIGTSAGAGFRSAISDPQSLTIIGFGALLTLFISITVLFVGHKLMKIPFGETAGILAGTQTHPAVLSYVSDASRNELPAMGYTSVYPLAMIAKILAAQTLLFLLI

SEQ ID NO: 279 - DNA, 1620 bp, Corynebacterium glutamicum
gtgagcttccttgtagaaaatcagttactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcggttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcatcgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggaattcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctag

SEQ ID NO: 280 - protein, 539 aa, Corynebacterium glutamicum; identical to SEQ ID NO: 278

SEQ ID NO: 281 - DNA, 99 bp, Artificial Sequence
  primer
catattcgcgccaatgcgacgtgaaggatacagggctatcaaacgataagatggggtgtctggggtaattgaagcctgcttttttatactaagttggca

SEQ ID NO: 282 - DNA, 99 bp, Artificial Sequence
  primer
agggtgttagaacagaagtatttcagaaaaccctcgcgcaaaagcacgagggtttgcagaagaggaagacgctcaagttagtataaaaaagctgaacga

SEQ ID NO: 283 - DNA, 22 bp, Artificial Sequence
  primer
gacgacgaaaagcaaagcccga

SEQ ID NO: 284 - DNA, 24 bp, Artificial Sequence
  primer
tggaatgcatagtaagaacctgtc

SEQ ID NO: 285 - DNA, 90 bp, Artificial Sequence
  primer
gaaattttgtaaaatatttttagtagcttaaatgtgattcaacatcactggagaaagtctttgaagcctgcttttttatactaagttggc

SEQ ID NO: 286 - DNA, 93 bp, Artificial Sequence
  primer
gatgaaaggtcattggggattatctgaatcagctcccctggaatgcaggggagcggcaagaatctcagcctttatttttcagattttattcgg

SEQ ID NO: 287 - DNA, 81 bp, Artificial Sequence
  Ptac promoter
ccccctgttgacaattaatcatcggctcgtataatgtgtggaattgtgagcggataacaatttcacacaggaaacagaatt

SEQ ID NO: 288 - DNA, 101 bp, Artificial Sequence
  P4701phi10 promoter
ccccctgtttgcaattaatcatcggctcgtataatgtgtggaatcgtgagcggataacaatttcacacaataattttgtttaactttaagaaggagatata

The invention claimed is:
1. A method for producing an objective substance, the method comprising:
    culturing a microorganism having an objective substance-producing ability in a medium to produce and accumulate the objective substance in the medium or in cells of the microorganism; and
    collecting the objective substance from the medium or the cells,
    wherein the microorganism has been modified so that the activity of a dicarboxylic acid exporter protein is reduced;
    wherein the gene encoding the dicarboxylic acid exporter protein is selected from the group consisting of yjjP gene, yjjB gene, yeeA gene, ynfM gene, sucE1 gene, and combinations thereof;
    wherein the yjjP gene is a DNA selected from the group consisting of:

(A) a DNA encoding a protein comprising the amino acid sequence of SEQ ID NO: 158 or 160;
(B) a DNA encoding a protein comprising the amino acid sequence of SEQ ID NO: 158 or 160, but including substitution, deletion, insertion, or addition of 1-10 amino acid residues, the protein having an activity to export a dicarboxylic acid;
(C) a DNA comprising the nucleotide sequence of SEQ ID NO: 157 or 159; and
(D) a DNA able to hybridize under stringent conditions with a nucleotide sequence complementary to the nucleotide sequence of SEQ ID NO: 157 or 159, or with a probe that can be prepared from the complementary nucleotide sequence, and encoding a protein having an activity to export a dicarboxylic acid;

wherein the yjjB gene is a DNA selected from the group consisting of:
(A) DNA encoding a protein comprising the amino acid sequence of SEQ ID NO: 162 or 164;
(B) DNA encoding a protein comprising the amino acid sequence of SEQ ID NO: 162 or 164, but including substitution, deletion, insertion, or addition of 1-10 amino acid residues, the protein having an activity to export a dicarboxylic acid;
(C) DNA comprising the nucleotide sequence of SEQ ID NO: 161 or 163; and
(D) DNA able to hybridize under stringent conditions with a nucleotide sequence complementary to the nucleotide sequence of SEQ ID NO: 161 or 163, or with a probe that can be prepared from the complementary nucleotide sequence, and encoding a protein having an activity to export a dicarboxylic acid;

wherein the yeeA gene is a DNA selected from the group consisting of:
(A) DNA encoding a protein comprising the amino acid sequence of SEQ ID NO: 166, 168, or 170;
(B) DNA encoding a protein comprising the amino acid sequence of SEQ ID NO: 166, 168, or 170, but including substitution, deletion, insertion, or addition of 1-10 amino acid residues, the protein having an activity to export a dicarboxylic acid;
(C) DNA comprising the nucleotide sequence of SEQ ID NO: 165, 167, or 169; and
(D) DNA able to hybridize under stringent conditions with a nucleotide sequence complementary to the nucleotide sequence of SEQ ID NO: 165, 167, or 169, or with a probe that can be prepared from the complementary nucleotide sequence, and encoding a protein having an activity to export a dicarboxylic acid;

wherein the ynfM gene is a DNA selected from the group consisting of:
(A) DNA encoding a protein comprising the amino acid sequence of SEQ ID NO: 172, 174, 176, 178, or 180;
(B) DNA encoding a protein comprising the amino acid sequence of SEQ ID NO: 172, 174, 176, 178, or 180, but including substitution, deletion, insertion, or addition of 1-10 amino acid residues, the protein having an activity to export a dicarboxylic acid;
(C) DNA comprising the nucleotide sequence of SEQ ID NO: 171, 173, 175, 177, or 179; and
(D) DNA able to hybridize under stringent conditions with a nucleotide sequence complementary to the nucleotide sequence of SEQ ID NO: 171, 173, 175, 177, or 179, or with a probe that can be prepared from the complementary nucleotide sequence, and encoding a protein having an activity to export a dicarboxylic acid;

wherein the sucE1 gene is a DNA selected from the group consisting of:
(A) DNA encoding a protein comprising the amino acid sequence of SEQ ID NO: 278 or 280;
(B) DNA encoding a protein comprising the amino acid sequence of SEQ ID NO: 278 or 280, but including substitution, deletion, insertion, or addition of 1-10 amino acid residues, the protein having an activity to export a dicarboxylic acid;
(C) DNA comprising the nucleotide sequence of SEQ ID NO: 277 or 279; and
(D) DNA able to hybridize under stringent conditions with a nucleotide sequence complementary to the nucleotide sequence of SEQ ID NO: 277 or 279, or with a probe that can be prepared from the complementary nucleotide sequence, and encoding a protein having an activity to export a dicarboxylic acid;
wherein said stringent conditions are 0.1×SSC, 0.1% SDS at 68° C.; and
wherein the objective substance is a metabolite derived from acetyl-CoA and/or an L-amino acid.

2. The method according to claim 1, wherein the activity of the dicarboxylic acid exporter protein is reduced by attenuating the expression of a gene encoding the dicarboxylic acid exporter protein or by deleting the gene.

3. The method according to claim 1, wherein the metabolite derived from acetyl-CoA and/or the L-amino acid is selected from the group consisting of isopropyl alcohol, ethanol, acetone, propylene, isoprene, 1,3-butanediol, 1,4-butanediol, 1-propanol, 1,3-propanediol, 1,2-propanediol, ethylene glycol, isobutanol, and combinations thereof.

4. The method according to claim 1, wherein the metabolite derived from acetyl-CoA and/or the L-amino acid is selected from the group consisting of citric acid, itaconic acid, acetic acid, butyric acid, 3-hydroxybutyric acid, polyhydroxybutyric acid, 3-hydroxyisobutyric acid, 3-aminoisobutyric acid, 2-hydroxyisobutyric acid, methacrylic acid, 6-aminocaproic acid, and combinations thereof.

5. The method according to claim 1, wherein the metabolite derived from acetyl-CoA and/or the L-amino acid is selected from the group consisting of polyglutamic acid, L-glutamic acid, L-glutamine, L-arginine, L-ornithine, L-citrulline, L-leucine, L-isoleucine, L-valine, L-cysteine, L-serine, L-proline, and combinations thereof.

6. The method according to claim 5, wherein the L-glutamic acid is monoammonium L-glutamate or monosodium L-glutamate.

7. The method according to claim 1, wherein the microorganism is a coryneform bacterium or a bacterium belonging to the family Enterobacteriaceae.

8. The method according to claim 7, wherein the coryneform bacterium is *Corynebacterium glutamicum*.

9. The method according to claim 7, wherein the bacterium belonging to the family Enterobacteriaceae is *Escherichia coli, Pantoea ananatis*, or *Enterobacter aerogenes*.

10. The method according to claim 1, wherein the dicarboxylic acid is selected from the group consisting of malic acid, succinic acid, fumaric acid, 2-hydroxyglutaric acid, and α-ketoglutaric acid.

11. The method according to claim 1, wherein the microorganism has been further modified so that malyl-CoA-producing ability is increased.

12. The method according to claim 1, wherein the microorganism has been further modified so that α-ketoglutarate synthase activity is increased.

* * * * *